US010316324B2

(12) United States Patent
Begemann et al.

(10) Patent No.: US 10,316,324 B2
(45) Date of Patent: Jun. 11, 2019

(54) COMPOSITIONS AND METHODS FOR MODIFYING GENOMES

(71) Applicant: BENSON HILL BIOSYSTEMS, INC., Research Triangle Park, NC (US)

(72) Inventors: Matthew Begemann, St. Louis, MO (US); Benjamin Neil Gray, Chapel Hill, NC (US)

(73) Assignee: Benson Hill Biosystems, Inc., Research Triange Park, NC (US)

( * ) Notice: Subject to any disclaimer, the term of this patent is extended or adjusted under 35 U.S.C. 154(b) by 0 days.

(21) Appl. No.: 16/058,718

(22) Filed: Aug. 8, 2018

(65) Prior Publication Data
US 2019/0048357 A1    Feb. 14, 2019

Related U.S. Application Data

(60) Provisional application No. 62/542,983, filed on Aug. 9, 2017, provisional application No. 62/551,958, filed on Aug. 30, 2017, provisional application No. 62/565,255, filed on Sep. 29, 2017, provisional application No. 62/599,226, filed on Dec. 15, 2017.

(51) Int. Cl.
*C12N 15/82* (2006.01)
*C07K 14/415* (2006.01)
(52) U.S. Cl.
CPC ............ *C12N 15/82* (2013.01); *C07K 14/415* (2013.01); *C07K 2319/00* (2013.01)
(58) Field of Classification Search
None
See application file for complete search history.

(56) References Cited

U.S. PATENT DOCUMENTS

| | | | |
|---|---|---|---|
| 7,462,481 | B2 | 12/2008 | Castle |
| 9,790,490 | B2 | 10/2017 | Zhang et al. |
| 9,896,696 | B2 | 2/2018 | Begemann et al. |
| 2014/0356956 | A1 | 12/2014 | Church et al. |
| 2016/0208243 | A1 | 7/2016 | Zhang et al. |
| 2016/0362668 | A1 | 12/2016 | May et al. |
| 2017/0114351 | A1 | 4/2017 | Mahfouz et al. |
| 2018/0148735 | A1 | 5/2018 | Begemann et al. |
| 2018/0362590 | A1 | 12/2018 | Monds et al. |

FOREIGN PATENT DOCUMENTS

| | | |
|---|---|---|
| CN | 103 981 215 B | 6/2016 |
| EP | 3 009 511 A2 | 4/2016 |
| WO | WO 2015/071474 A2 | 5/2015 |
| WO | WO 2017/015015 A1 | 1/2017 |
| WO | WO 2017/141173 A2 | 8/2017 |

OTHER PUBLICATIONS

Begemann, M., et al., "Characterization and Validation of a Novel Group of Type V, Class 2 Nucleasese for in vivo Genome Editing," bioRxiv, 2017, http://dx.doi.org/10.1101/192799, pp. 1-9.
Certified Copy of U.S. Appl. No. 62/193,921, for "CRISPR-Associated Protein from *Francisella* And Uses Related Thereto," filed Jul. 17, 2015, pp. 1-68.
Database UniProt:D8E0G1, "Uncharacterized Protein," 2010, 1 page.
Database Unitprot:A0A091FC75, "Uncharacterized Protein," 2014, 1 page.
NCBI Reference Sequence: WP_003034647.1 for "conserved hypothetical protein [Francisella novicida]," May 6, 2013, 1 page.
NCBI Reference GenBank AJI56734.1 for "CRISPR-associated protein Cpf1, subtype PREFRAN [Francisella philomiragia]," Sep. 15, 2014, 1 page.
Zetsche, B., et al., "Cpf1 Is a Single RNA-Guided Endonuclease of a Class 2 CRISPR-Cas System," *Cell*, 2015, vol. 163, pp. 1-13.
Database UniParc—Accession No. UPI00058064FB, 2015, 2 pages.
Ma, Xingliang, et al., "CRISPR/Cas9 Platforms for Genome Editing in Plants: Developments and Applications," *Molecular Plant*, 2016, vol. 9(7), 961-974.
Mikami, M., et al., "Comparison of CRISPR/Cas9 expression constructs for efficient targeting mutagenesis in rice," *Plant Mol. Bio.*, 2015, vol. 88(6), pp. 561-572.

*Primary Examiner* — Brent T Page
(74) *Attorney, Agent, or Firm* — Womble Bond Dickinson (US) LLP

(57) ABSTRACT

Compositions and methods for modifying genomic DNA sequences are provided. The methods produce double-stranded breaks (DSBs) at pre-determined target sites in a genomic DNA sequence, resulting in mutation, insertion, and/or deletion of DNA sequences at the target site(s) in a genome. Compositions comprise DNA constructs comprising nucleotide sequences that encode a Cms1 protein operably linked to a promoter that is operable in the cells of interest. The DNA constructs can be used to direct the modification of genomic DNA at pre-determined genomic loci. Methods to use these DNA constructs to modify genomic DNA sequences are described herein. Additionally, compositions and methods for modulating the expression of genes are provided. Compositions comprise DNA constructs comprising a promoter that is operable in the cells of interest operably linked to nucleotide sequences that encode a mutated Cms1 protein with an abolished ability to produce DSBs, optionally linked to a domain that regulates transcriptional activity. The methods can be used to up- or down-regulate the expression of genes at predetermined genomic loci.

20 Claims, 4 Drawing Sheets

Specification includes a Sequence Listing.

US 10,316,324 B2

COMPOSITIONS AND METHODS FOR MODIFYING GENOMES

FIELD OF THE INVENTION

The present invention relates to compositions and methods for editing genomic sequences at pre-selected locations and for modulating gene expression.

REFERENCE TO A SEQUENCE LISTING SUBMITTED AS A TEXT FILE VIA EFS-WEB

The official copy of the sequence listing is submitted concurrently with the specification as a text file via EFS-Web, in compliance with the American Standard Code for Information Interchange (ASCII), with a file name of BHP017P5 Sequence Listing_ST25.txt, a creation date of Jul. 24, 2018, and a size of 1,848 Kb. The sequence listing filed via EFS-Web is part of the specification and is hereby incorporated in its entirety by reference herein.

BACKGROUND OF THE INVENTION

Modification of genomic DNA is of immense importance for basic and applied research. Genomic modifications have the potential to elucidate and in some cases to cure the causes of disease and to provide desirable traits in the cells and/or individuals comprising said modifications. Genomic modification may include, for example, modification of plant, animal, fungal, and/or prokaryotic genomic modification. The most common methods for modifying genomic DNA tend to modify the DNA at random sites within the genome, but recent discoveries have enabled site-specific genomic modification. Such technologies rely on the creation of a DSB at the desired site. This DSB causes the recruitment of the host cell's native DNA-repair machinery to the DSB. The DNA-repair machinery may be harnessed to insert heterologous DNA at a pre-determined site, to delete native genomic DNA, or to produce point mutations, insertions, or deletions at a desired site. Of particular interest for site-specific genomic modifications are Clustered, Regularly Interspersed Short Palindromic Repeat (CRISPR) nucleases. CRISPR nucleases use a guide molecule, often a guide RNA molecule, that interacts with the nuclease and base pairs with the targeted DNA, allowing the nuclease to produce a double-stranded break (DSB) at the desired site. The production of DSBs requires the presence of a protospacer-adjacent motif (PAM) sequence; following recognition of the PAM sequence, the CRISPR nuclease is able to produce the desired DSB. Cms1 CRISPR nucleases are a class of CRISPR nucleases that have certain desirable properties relative to other CRISPR nucleases such as Cas9 nucleases.

One area in which genomic modification is practiced is in the modification of plant genomic DNA. Modification of plant genomic DNA is of immense importance to both basic and applied plant research. Transgenic plants with stably modified genomic DNA can have new traits such as herbicide tolerance, insect resistance, and/or accumulation of valuable proteins including pharmaceutical proteins and industrial enzymes imparted to them. The expression of native plant genes may be up- or down-regulated or otherwise altered (e.g., by changing the tissue(s) in which native plant genes are expressed), their expression may be abolished entirely, DNA sequences may be altered (e.g., through point mutations, insertions, or deletions), or new non-native genes may be inserted into a plant genome to impart new traits to the plant.

SUMMARY OF THE INVENTION

Compositions and methods for modifying genomic DNA sequences using Cms1 CRISPR systems are provided. As used herein, genomic DNA refers to linear and/or chromosomal DNA and/or to plasmid or other extrachromosomal DNA sequences present in the cell or cells of interest. The methods produce double-stranded breaks (DSBs) at pre-determined target sites in a genomic DNA sequence, resulting in mutation, insertion, and/or deletion of DNA sequences at the target site(s) in a genome. Compositions comprise DNA constructs comprising nucleotide sequences that encode a Cms1 protein operably linked to a promoter that is operable in the cells of interest. In some embodiments, a Cms1 protein comprises at least one amino acid motif selected from the group consisting of SEQ ID NOs:177-186. In other embodiments, a Cms1 protein comprises at least one amino acid motif selected from the group consisting of SEQ ID NOs:288-289 and 187-201. In other embodiments, a Cms1 protein comprises at least one amino acid motif selected from the group consisting of SEQ ID NOs:290-296. In certain preferred embodiments, a Cms1 protein comprises more than one amino acid motif selected from the group consisting of SEQ ID NOs:177-186. In certain preferred embodiments, a Cms1 protein comprises more than one amino acid motif selected from the group consisting of SEQ ID NOs:288-289 and 187-201. In certain preferred embodiments, a Cms1 protein comprises more than one amino acid motif selected from the group consisting of SEQ ID NOs: 290-296. Particular Cms1 protein sequences are set forth in SEQ ID NOs: 10, 11, 20-23, 30-69, 154-156, 208-211, and 222-254; particular Cms1 protein-encoding polynucleotide sequences are set forth in SEQ ID NOs: 16-19, 24-27, 70-146, 174-176, 212-215, and 255-287. In certain preferred embodiments, a Cms1 protein has at least about 80% identity with a sequence selected from the group consisting of SEQ ID NOs: 16-19, 24-27, 70-146, 174-176, 212-215, and 255-287. The DNA constructs comprising polynucleotide sequences that encode the Cms1 proteins of the invention, or the Cms1 proteins of the invention themselves, can be used to direct the modification of genomic DNA at pre-determined genomic loci. Methods to use these DNA constructs to modify genomic DNA sequences are described herein. Modified eukaryotes and eukaryotic cells, including yeast, amoebae, insects, fungi, mammals, plants, plant cells, plant parts and seeds as well as modified prokaryotes, including bacteria and archaea, are also encompassed. Compositions and methods for modulating the expression of genes are also provided. The methods target protein(s) to pre-determined sites in a genome to effect an up- or down-regulation of a gene or genes whose expression is regulated by the targeted site in the genome. Compositions comprise DNA constructs comprising nucleotide sequences that encode a modified Cms1 protein with diminished or abolished nuclease activity, optionally fused to a transcriptional activation or repression domain. Methods to use these DNA constructs to modify gene expression are described herein.

DETAILED DESCRIPTION OF THE INVENTION

Figure 1:
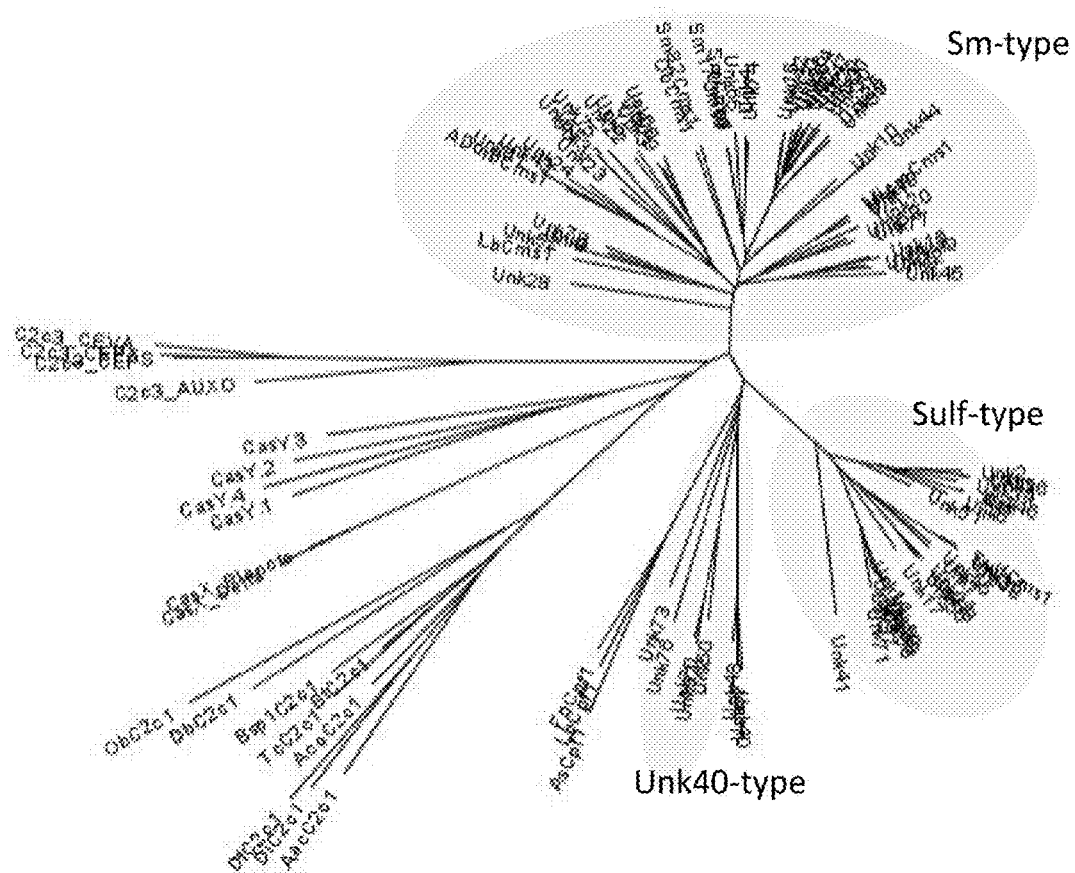
FIG. 1 shows a phylogenetic tree drawn from a RuvC-anchored MUSCLE alignment of the Type V nuclease amino acid sequences indicated. Sm-type, Sulf-type, and Unk40-type Cms1 nucleases are indicated.

Methods and compositions are provided herein for the control of gene expression involving sequence targeting, such as genome perturbation or gene-editing, that relate to the CRISPR-Cms system and components thereof. The CRISPR enzymes of the invention are selected from a Cms enzyme, e.g. a Cms1 ortholog or a mutated Cms1 enzyme. Cms1 is an abbreviation for CRISPR from Microgenomates and Smithella, and is so named because some bacterial species in these groups encode Cms1 nucleases; the terms Csm1 and Cms1 are used interchangeably herein. Cms1 nucleases may also be referred to as Cas12f nucleases. The methods and compositions include nucleic acids to bind target DNA sequences. This is advantageous as nucleic acids are much easier and less expensive to produce than, for example, peptides, and the specificity can be varied according to the length of the stretch where homology is sought. Complex 3-D positioning of multiple fingers, for example is not required.

Also provided are nucleic acids encoding the Cms1 polypeptides, as well as methods of using Cms1 polypeptides to modify chromosomal (i.e., genomic) or organellar DNA sequences of host cells including plant cells. The Cms1 polypeptides interact with specific guide RNAs (gRNAs), which direct the Cms1 endonuclease to a specific target site, at which site the Cms1 endonuclease introduces a double-stranded break that can be repaired by a DNA repair process such that the DNA sequence is modified. Since the specificity is provided by the guide RNA, the Cms1 polypeptide is universal and can be used with different guide RNAs to target different genomic sequences. Cms1 endonucleases have certain advantages over the Cas nucleases (e.g., Cas9) traditionally used with CRISPR arrays. For example, Cms1-associated CRISPR arrays are processed into mature crRNAs without the requirement of an additional trans-activating crRNA (tracrRNA). Also, Cms1-crRNA complexes can cleave target DNA preceded by a short protospacer-adjacent motif (PAM) that is often T-rich, in contrast to the G-rich PAM following the target DNA for many Cas9 systems. Further, Cms1 nucleases can introduce a staggered DNA double-strand break. The methods disclosed herein can be used to target and modify specific chromosomal sequences and/or introduce exogenous sequences at targeted locations in the genome of eukaryotic and prokaryotic cells. The methods can further be used to introduce sequences or modify regions within organelles (e.g., chloroplasts and/or mitochondria). Furthermore, the targeting is specific with limited off target effects.

I. Cms1 Endonucleases

Provided herein are Cms1 endonucleases, and fragments and variants thereof, for use in modifying genomes including plant genomes. As used herein, the term Cms1 endonucleases or Cms1 polypeptides refers to homologs, orthologs, and variants of the Cms1 polypeptide sequence set forth in SEQ ID NOs:10, 11, 20-23, 30-69, 154-156, 208-211, and 222-254. Typically, Cms1 endonucleases can act without the use of tracrRNAs and can introduce a staggered DNA double-strand break. In general, Cms1 polypeptides comprise at least one RNA recognition and/or RNA binding domain. RNA recognition and/or RNA binding domains interact with guide RNAs. Typically the guide RNA comprises a region with a stem-loop structure that interacts with the Cms1 polypeptide. This stem-loop often comprises the sequence UCUACN$_{3-5}$GUAGAU (SEQ ID NOs:312-314, encoded by SEQ ID NOs:315-317), with "UCUAC" and "GUAGA" base-pairing to form the stem of the stem-loop. N$_{3-5}$ denotes that any base may be present at this location, and 3, 4, or 5 nucleotides may be included at this location. Cms1 polypeptides can also comprise nuclease domains (i.e., DNase or RNase domains), DNA binding domains, helicase domains, RNAse domains, protein-protein interaction domains, dimerization domains, as well as other domains. In specific embodiments, a Cms1 polypeptide, or a polynucleotide encoding a Cms1 polypeptide, comprises: an RNA-binding portion that interacts with the DNA-targeting RNA, and an activity portion that exhibits site-directed enzymatic activity, such as a RuvC endonuclease domain.

Cms1 polypeptides can be wild type Cms1 polypeptides, modified Cms1 polypeptides, or a fragment of a wild type or modified Cms1 polypeptide. The Cms1 polypeptide can be modified to increase nucleic acid binding affinity and/or specificity, alter an enzymatic activity, and/or change another property of the protein. For example, nuclease (i.e., DNase, RNase) domains of the Cms1 polypeptide can be modified, deleted, or inactivated. Alternatively, the Cms1 polypeptide can be truncated to remove domains that are not essential for the function of the protein.

In some embodiments, the Cms1 polypeptide can be derived from a wild type Cms1 polypeptide or fragment thereof. In other embodiments, the Cms1 polypeptide can be derived from a modified Cms1 polypeptide. For example, the amino acid sequence of the Cms1 polypeptide can be modified to alter one or more properties (e.g., nuclease activity, affinity, stability, etc.) of the protein. Alternatively, domains of the Cms1 polypeptide not involved in RNA-guided cleavage can be eliminated from the protein such that the modified Cms1 polypeptide is smaller than the wild type Cms1 polypeptide.

In general, a Cms1 polypeptide comprises at least one nuclease (i.e., DNase) domain, but need not contain an HNH domain such as the one found in Cas9 proteins. For example, a Cms1 polypeptide can comprise a RuvC or RuvC-like nuclease domain. In some embodiments, the Cms1 polypeptide can be modified to inactivate the nuclease domain so that it is no longer functional. In some embodiments in which one of the nuclease domains is inactive, the Cms1 polypeptide does not cleave double-stranded DNA. In specific embodiments, the mutated Cms1 polypeptide comprises one or more mutations in a position corresponding to positions 701 or 922 of SmCms1 (SEQ ID NO:10) or to positions 848 and 1213 of SulfCms1 (SEQ ID NO:11) when aligned for maximum identity that reduces or eliminates the nuclease activity. The nuclease domain can be modified using well-known methods, such as site-directed mutagenesis, PCR-mediated mutagenesis, and total gene synthesis, as well as other methods known in the art. Cms1 proteins with inactivated nuclease domains (dCms1 proteins) can be used to modulate gene expression without modifying DNA sequences. In certain embodiments, a dCms1 protein may be targeted to particular regions of a genome such as promoters for a gene or genes of interest through the use of appropriate gRNAs. The dCms1 protein can bind to the desired region of DNA and may interfere with RNA polymerase binding to this region of DNA and/or with the binding of transcription factors to this region of DNA. This technique may be used to up- or down-regulate the expression of one or more genes of interest. In certain other embodiments, the dCms1 protein may be fused to a repressor domain to further downregulate the expression of a gene or genes whose expression is regulated by interactions of RNA polymerase, transcription factors, or other transcriptional regulators with the region of chromosomal DNA targeted by the gRNA. In certain other embodiments, the dCms1 protein may be fused to an activation domain to effect an upregulation of a gene or genes whose expression is regulated by interactions of RNA polymerase, transcription factors, or other transcriptional regulators with the region of chromosomal DNA targeted by the gRNA.

The Cms1 polypeptides disclosed herein can further comprise at least one nuclear localization signal (NLS). In general, an NLS comprises a stretch of basic amino acids. Nuclear localization signals are known in the art (see, e.g., Lange et al., *J. Biol. Chem.* (2007) 282:5101-5105). The NLS can be located at the N-terminus, the C-terminus, or in an internal location of the Cms1 polypeptide. In some embodiments, the Cms1 polypeptide can further comprise at least one cell-penetrating domain. The cell-penetrating domain can be located at the N-terminus, the C-terminus, or in an internal location of the protein.

The Cms1 polypeptide disclosed herein can further comprise at least one plastid targeting signal peptide, at least one mitochondrial targeting signal peptide, or a signal peptide targeting the Cms1 polypeptide to both plastids and mitochondria. Plastid, mitochondrial, and dual-targeting signal peptide localization signals are known in the art (see, e.g., Nassoury and Morse (2005) *Biochim Biophys Acta* 1743:5-19; Kunze and Berger (2015) *Front Physiol* 6:259; Herrmann and Neupert (2003) *IUBMB Life* 55:219-225; Soll (2002) *Curr Opin Plant Biol* 5:529-535; Carrie and Small (2013) *Biochim Biophys Acta* 1833:253-259; Carrie et al. (2009) *FEBS J* 276:1187-1195; Silva-Filho (2003) *Curr Opin Plant Biol* 6:589-595; Peeters and Small (2001) *Biochim Biophys Acta* 1541:54-63; Murcha et al. (2014) *J Exp Bot* 65:6301-6335; Mackenzie (2005) *Trends Cell Biol* 15:548-554; Glaser et al. (1998) *Plant Mol Biol* 38:311-338). The plastid, mitochondrial, or dual-targeting signal peptide can be located at the N-terminus, the C-terminus, or in an internal location of the Cms1 polypeptide.

In still other embodiments, the Cms1 polypeptide can also comprise at least one marker domain. Non-limiting examples of marker domains include fluorescent proteins, purification tags, and epitope tags. In certain embodiments, the marker domain can be a fluorescent protein. Non limiting examples of suitable fluorescent proteins include green fluorescent proteins (e.g., GFP, GFP-2, tagGFP, turboGFP, EGFP, Emerald, Azami Green, Monomeric Azami Green, CopGFP, AceGFP, ZsGreen1), yellow fluorescent proteins (e.g. YFP, EYFP, Citrine, Venus, YPet, PhiYFP, ZsYellow1), blue fluorescent proteins (e.g. EBFP, EBFP2, Azurite, mKalama1, GFPuv, Sapphire, T-sapphire), cyan fluorescent proteins (e.g. ECFP, Cerulean, CyPet, AmCyan1, Midoriishi-Cyan), red fluorescent proteins (mKate, mKate2, mPlum, DsRed monomer, mCherry, mRFP1, DsRed-Express, DsRed2, DsRed-Monomer, HcRed-Tandem, HcRed1, AsRed2, eqFP611, mRasberry, mStrawberry, Jred), and orange fluorescent proteins (mOrange, mKO, Kusabira-Orange, Monomeric Kusabira-Orange, mTangerine, tdTomato) or any other suitable fluorescent protein. In other embodiments, the marker domain can be a purification tag and/or an epitope tag. Exemplary tags include, but are not limited to, glutathione-S-transferase (GST), chitin binding protein (CBP), maltose binding protein, thioredoxin (TRX), poly(NANP), tandem affinity purification (TAP) tag, myc, AcV5, AU1, AUS, E, ECS, E2, FLAG, HA, nus, Softag 1, Softag 3, Strep, SBP, Glu-Glu, HSV, KT3, S, 51, T7, V5, VSV-G, 6×His, biotin carboxyl carrier protein (BCCP), and calmodulin.

In certain embodiments, the Cms1 polypeptide may be part of a protein-RNA complex comprising a guide RNA. The guide RNA interacts with the Cms1 polypeptide to direct the Cms1 polypeptide to a specific target site, wherein the 5' end of the guide RNA can base pair with a specific protospacer sequence of the nucleotide sequence of interest in the plant genome, whether part of the nuclear, plastid, and/or mitochondrial genome. As used herein, the term "DNA-targeting RNA" refers to a guide RNA that interacts with the Cms1 polypeptide and the target site of the nucleotide sequence of interest in the genome of a plant cell. A DNA-targeting RNA, or a DNA polynucleotide encoding a DNA-targeting RNA, can comprise: a first segment comprising a nucleotide sequence that is complementary to a sequence in the target DNA, and a second segment that interacts with a Cms1 polypeptide.

The polynucleotides encoding Cms1 polypeptides disclosed herein can be used to isolate corresponding sequences from other prokaryotic or eukaryotic organisms, or from metagenomically-derived sequences whose native host organism is unclear or unknown. In this manner, methods such as PCR, hybridization, and the like can be used to identify such sequences based on their sequence homology or identity to the sequences set forth herein. Sequences isolated based on their sequence identity to the entire Cms1 sequences set forth herein or to variants and fragments thereof are encompassed by the present invention. Such sequences include sequences that are orthologs of the disclosed Cms1 sequences. "Orthologs" is intended to mean genes derived from a common ancestral gene and which are found in different species as a result of speciation. Genes found in different species are considered orthologs when their nucleotide sequences and/or their encoded protein sequences share at least about 75%, about 80%, about 85%, about 90%, about 91%, about 92%, about 93%, about 94%, about 95%, about 96%, about 97%, about 98%, about 99%, or greater sequence identity. Functions of orthologs are often highly conserved among species. Thus, isolated polynucleotides that encode polypeptides having Cms1 endonuclease activity and which share at least about 75% or more sequence identity to the sequences disclosed herein, are encompassed by the present invention. As used herein, Cms1 endonuclease activity refers to CRISPR endonuclease activity wherein, a guide RNA (gRNA) associated with a Cms1 polypeptide causes the Cms1-gRNA complex to bind to a pre-determined nucleotide sequence that is complementary to the gRNA; and wherein Cms1 activity can introduce a double-stranded break at or near the site targeted by the gRNA. In certain embodiments, this double-stranded break may be a staggered DNA double-stranded break. As used herein a "staggered DNA double-stranded break" can result in a double strand break with about 1, about 2, about 3, about 4, about 5, about 6, about 7, about 8, about 9, or about 10 nucleotides of overhang on either the 3' or 5' ends following cleavage. In specific embodiments, the Cms1 polypeptide introduces a staggered DNA double-stranded break with a 5' overhang. The double strand break can occur at or near the sequence to which the DNA-targeting RNA (e.g., guide RNA) sequence is targeted.

Fragments and variants of the Cms1 polynucleotides and Cms1 amino acid sequences encoded thereby that retain Cms1 nuclease activity are encompassed herein. By "Cms1 nuclease activity" is intended the binding of a pre-determined DNA sequence as mediated by a guide RNA. In embodiments wherein the Cms1 nuclease retains a functional RuvC domain, Cms1 nuclease activity can further comprise double-strand break induction. By "fragment" is intended a portion of the polynucleotide or a portion of the amino acid sequence. "Variants" is intended to mean substantially similar sequences. For polynucleotides, a variant comprises a polynucleotide having deletions (i.e., truncations) at the 5' and/or 3' end; deletion and/or addition of one or more nucleotides at one or more internal sites in the native polynucleotide; and/or substitution of one or more nucleotides at one or more sites in the native polynucleotide. As used herein, a "native" polynucleotide or polypeptide comprises a naturally occurring nucleotide sequence or amino acid sequence, respectively. Generally, variants of a particular polynucleotide of the invention will have at least about 75%, 80%, 85%, 90%, 91%, 92%, 93%, 94%, 95%, 96%, 97%, 98%, 99% or more sequence identity to that particular polynucleotide as determined by sequence alignment programs and parameters as described elsewhere herein.

"Variant" amino acid or protein is intended to mean an amino acid or protein derived from the native amino acid or protein by deletion (so-called truncation) of one or more amino acids at the N-terminal and/or C-terminal end of the native protein; deletion and/or addition of one or more amino acids at one or more internal sites in the native protein; or substitution of one or more amino acids at one or more sites in the native protein. Variant proteins encompassed by the present invention are biologically active, that is they continue to possess the desired biological activity of the native protein. Biologically active variants of a native polypeptide will have at least about 80%, 85%, 90%, 91%, 92%, 93%, 94%, 95%, 96%, 97%, 98%, 99% or more sequence identity to the amino acid sequence for the native sequence as determined by sequence alignment programs and parameters described herein. A biologically active variant of a protein of the invention may differ from that protein by as few as 1-15 amino acid residues, as few as 1-10, such as 6-10, as few as 5, as few as 4, 3, 2, or even 1 amino acid residue.

Variant sequences may also be identified by analysis of existing databases of sequenced genomes. In this manner, corresponding sequences can be identified and used in the methods of the invention.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) CABIOS 4:11-17; the local alignment algorithm of Smith et al. (1981) Adv. Appl. Math. 2:482; the global alignment algorithm of Needleman and Wunsch (1970) J Mol. Biol. 48:443-453; the search-for-local alignment method of Pearson and Lipman (1988) Proc. Natl. Acad. Sci. 85:2444-2448; the algorithm of Karlin and Altschul (1990) Proc. Natl. Acad. Sci. USA 87:2264-2268, modified as in Karlin and Altschul (1993) Proc. Natl. Acad. Sci. USA 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) Gene 73:237-244; Higgins et al. (1989) CABIOS 5:151-153; Corpet et al. (1988) Nucleic Acids Res. 16:10881-90; Huang et al. (1992) CABIOS 8:155-65; and Pearson et al. (1994) Meth. Mol. Biol. 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences. The MUSCLE algorithm for multiple sequence alignment may be used for comparisons of multiple nucleic acid or protein sequences (Edgar (2004) Nucleic Acids Research 32:1792-1797). The BLAST programs of Altschul et al (1990) J Mol. Biol. 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. To obtain gapped alignments for comparison purposes, Gapped BLAST (in BLAST 2.0) can be utilized as described in Altschul et al. (1997) Nucleic Acids Res. 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See the website at www.ncbi.nlm.nih.gov. Alignment may also be performed manually by inspection.

The nucleic acid molecules encoding Cms1 polypeptides, or fragments or variants thereof, can be codon optimized for expression in a plant of interest or other cell or organism of interest. A "codon-optimized gene" is a gene having its frequency of codon usage designed to mimic the frequency of preferred codon usage of the host cell. Nucleic acid molecules can be codon optimized, either wholly or in part. Because any one amino acid (except for methionine and tryptophan) is encoded by a number of codons, the sequence of the nucleic acid molecule may be changed without changing the encoded amino acid. Codon optimization is when one or more codons are altered at the nucleic acid level such that the amino acids are not changed but expression in a particular host organism is increased. Those having ordinary skill in the art will recognize that codon tables and other references providing preference information for a wide range of organisms are available in the art (see, e.g., Zhang et al. (1991) Gene 105:61-72; Murray et al. (1989) Nucl. Acids Res. 17:477-508). Methodology for optimizing a nucleotide sequence for expression in a plant is provided, for example, in U.S. Pat. No. 6,015,891, and the references cited therein. Examples of codon optimized polynucleotides for expression in a plant are set forth in: SEQ ID NOs:16-19, 110-120, and 174-176.

II. Fusion Proteins

Fusion proteins are provided herein comprising a Cms1 polypeptide, or a fragment or variant thereof, and an effector domain. The Cms1 polypeptide can be directed to a target site by a guide RNA, at which site the effector domain can modify or effect the targeted nucleic acid sequence. The effector domain can be a cleavage domain, an epigenetic modification domain, a transcriptional activation domain, or a transcriptional repressor domain. The fusion protein can further comprise at least one additional domain chosen from a nuclear localization signal, plastid signal peptide, mitochondrial signal peptide, signal peptide capable of protein trafficking to multiple subcellular locations, a cell-penetrating domain, or a marker domain, any of which can be located at the N-terminus, C-terminus, or an internal location of the fusion protein. The Cms1 polypeptide can be located at the N-terminus, the C-terminus, or in an internal location of the fusion protein. The Cms1 polypeptide can be directly fused to the effector domain, or can be fused with a linker. In specific embodiments, the linker sequence fusing the Cms1 polypeptide with the effector domain can be at least 1, 2, 3, 4, 5, 6, 7, 8, 9, 10, 15, 20, 25, 30, 40, or 50 amino acids in length. For example, the linker can range from 1-5, 1-10, 1-20, 1-50, 2-3, 3-10, 3-20, 5-20, or 10-50 amino acids in length.

In some embodiments, the Cms1 polypeptide of the fusion protein can be derived from a wild type Cms1 protein. The Cms1-derived protein can be a modified variant or a fragment. In some embodiments, the Cms1 polypeptide can be modified to contain a nuclease domain (e.g. a RuvC or RuvC-like domain) with reduced or eliminated nuclease activity. For example, the Cms1-derived polypeptide can be modified such that the nuclease domain is deleted or mutated such that it is no longer functional (i.e., the nuclease activity is absent). Particularly, a Cms1 polypeptide can have a mutation in a position corresponding to positions 701 or 922 of SmCms1 (SEQ ID NO:10) or to positions 848 and 1213 of SulfCms1 (SEQ ID NO:11) when aligned for maximum identity. The nuclease domain can be inactivated by one or more deletion mutations, insertion mutations, and/or substitution mutations using known methods, such as site-directed mutagenesis, PCR-mediated mutagenesis, and total gene synthesis, as well as other methods known in the art. In an exemplary embodiment, the Cms1 polypeptide of the fusion protein is modified by mutating the RuvC-like domain such that the Cms1 polypeptide has no nuclease activity.

The fusion protein also comprises an effector domain located at the N-terminus, the C-terminus, or in an internal location of the fusion protein. In some embodiments, the effector domain is a cleavage domain. As used herein, a "cleavage domain" refers to a domain that cleaves DNA. The cleavage domain can be obtained from any endonuclease or exonuclease. Non-limiting examples of endonucleases from which a cleavage domain can be derived include, but are not limited to, restriction endonucleases and homing endonucleases. See, for example, New England Biolabs Catalog or Belfort et al. (1997) *Nucleic Acids Res.* 25:3379-3388. Additional enzymes that cleave DNA are known (e.g., S1 Nuclease; mung bean nuclease; pancreatic DNase I; micrococcal nuclease; yeast HO endonuclease). See also Linn et al. (eds.) Nucleases, Cold Spring Harbor Laboratory Press, 1993. One or more of these enzymes (or functional fragments thereof) can be used as a source of cleavage domains.

In some embodiments, the cleavage domain can be derived from a type II-S endonuclease. Type II-S endonucleases cleave DNA at sites that are typically several base pairs away from the recognition site and, as such, have separable recognition and cleavage domains. These enzymes generally are monomers that transiently associate to form dimers to cleave each strand of DNA at staggered locations. Non-limiting examples of suitable type II-S endonucleases include BfiI, BpmI, BsaI, BsgI, BsmBI, BsmI, BspMI, FokI, MboII, and SapI.

In certain embodiments, the type II-S cleavage can be modified to facilitate dimerization of two different cleavage domains (each of which is attached to a Cms1 polypeptide or fragment thereof). In embodiments wherein the effector domain is a cleavage domain the Cms1 polypeptide can be modified as discussed herein such that its endonuclease activity is eliminated. For example, the Cms1 polypeptide can be modified by mutating the RuvC-like domain such that the polypeptide no longer exhibits endonuclease activity.

In other embodiments, the effector domain of the fusion protein can be an epigenetic modification domain. In general, epigenetic modification domains alter histone structure and/or chromosomal structure without altering the DNA sequence. Changes in histone and/or chromatin structure can lead to changes in gene expression. Examples of epigenetic modification include, without limit, acetylation or methylation of lysine residues in histone proteins, and methylation of cytosine residues in DNA. Non-limiting examples of suitable epigenetic modification domains include histone acetyltansferase domains, histone deacetylase domains, histone methyltransferase domains, histone demethylase domains, DNA methyltransferase domains, and DNA demethylase domains.

In embodiments in which the effector domain is a histone acetyltansferase (HAT) domain, the HAT domain can be derived from EP300 (i.e., E1A binding protein p300), CREBBP (i.e., CREB-binding protein), CDY1, CDY2, CDYL1, CLOCK, ELP3, ESA1, GCN5 (KAT2A), HAT1, KAT2B, KAT5, MYST1, MYST2, MYST3, MYST4, NCOA1, NCOA2, NCOA3, NCOAT, P/CAF, Tip60, TAFII250, or TF3C4. In embodiments wherein the effector domain is an epigenetic modification domain, the Cms1 polypeptide can be modified as discussed herein such that its endonuclease activity is eliminated. For example, the Cms1 polypeptide can be modified by mutating the RuvC-like domain such that the polypeptide no longer possesses nuclease activity.

In some embodiments, the effector domain of the fusion protein can be a transcriptional activation domain. In general, a transcriptional activation domain interacts with transcriptional control elements and/or transcriptional regulatory proteins (i.e., transcription factors, RNA polymerases, etc.) to increase and/or activate transcription of one or more genes. In some embodiments, the transcriptional activation domain can be, without limit, a herpes simplex virus VP16 activation domain, VP64 (which is a tetrameric derivative of VP16), a NFκB p65 activation domain, p53 activation domains 1 and 2, a CREB (cAMP response element binding protein) activation domain, an E2A activation domain, and an NFAT (nuclear factor of activated T-cells) activation domain. In other embodiments, the transcriptional activation domain can be Gal4, Gcn4, MLL, Rtg3, Gln3, Oaf1, Pip2, Pdr1, Pdr3, Pho4, and Leu3. The transcriptional activation domain may be wild type, or it may be a modified version of the original transcriptional activation domain. In some embodiments, the effector domain of the fusion protein is a VP16 or VP64 transcriptional activation domain. In embodiments wherein the effector domain is a transcriptional activation domain, the Cms1 polypeptide can be modified as discussed herein such that its endonuclease activity is eliminated. For example, the Cms1 polypeptide can be modified by mutating the RuvC-like domain such that the polypeptide no longer possesses nuclease activity.

In still other embodiments, the effector domain of the fusion protein can be a transcriptional repressor domain. In general, a transcriptional repressor domain interacts with transcriptional control elements and/or transcriptional regulatory proteins (i.e., transcription factors, RNA polymerases, etc.) to decrease and/or terminate transcription of one or more genes. Non-limiting examples of suitable transcriptional repressor domains include inducible cAMP early repressor (ICER) domains, Kruppel-associated box A (KRAB-A) repressor domains, YY1 glycine rich repressor domains, Spl-like repressors, E(spl) repressors, I.kappa.B repressor, and MeCP2. In embodiments wherein the effector domain is a transcriptional repressor domain, the Cms1 polypeptide can be modified as discussed herein such that its endonuclease activity is eliminated. For example, the Cms1 polypeptide can be modified by mutating the RuvC-like domain such that the polypeptide no longer possesses nuclease activity.

In some embodiments, the fusion protein further comprises at least one additional domain. Non-limiting examples of suitable additional domains include nuclear localization signals, cell-penetrating or translocation domains, and marker domains.

When the effector domain of the fusion protein is a cleavage domain, a dimer comprising at least one fusion protein can form. The dimer can be a homodimer or a heterodimer. In some embodiments, the heterodimer comprises two different fusion proteins. In other embodiments, the heterodimer comprises one fusion protein and an additional protein.

The dimer can be a homodimer in which the two fusion protein monomers are identical with respect to the primary amino acid sequence. In one embodiment where the dimer is a homodimer, the Cms1 polypeptide can be modified such that the endonuclease activity is eliminated. In certain embodiments wherein the Cms1 polypeptide is modified such that endonuclease activity is eliminated, each fusion protein monomer can comprise an identical Cms1 polypeptide and an identical cleavage domain. The cleavage domain can be any cleavage domain, such as any of the exemplary cleavage domains provided herein. In such embodiments, specific guide RNAs would direct the fusion protein monomers to different but closely adjacent sites such that, upon dimer formation, the nuclease domains of the two monomers would create a double stranded break in the target DNA.

The dimer can also be a heterodimer of two different fusion proteins. For example, the Cms1 polypeptide of each fusion protein can be derived from a different Cms1 polypeptide or from an orthologous Cms1 polypeptide. For example, each fusion protein can comprise a Cms1 polypeptide derived from a different source. In these embodiments, each fusion protein would recognize a different target site (i.e., specified by the protospacer and/or PAM sequence). For example, the guide RNAs could position the heterodimer to different but closely adjacent sites such that their nuclease domains produce an effective double stranded break in the target DNA.

Alternatively, two fusion proteins of a heterodimer can have different effector domains. In embodiments in which the effector domain is a cleavage domain, each fusion protein can contain a different modified cleavage domain. In these embodiments, the Cms1 polypeptide(s) can be modified such that their endonuclease activities are eliminated. The two fusion proteins forming a heterodimer can differ in both the Cms1 polypeptide domain and the effector domain.

In any of the above-described embodiments, the homodimer or heterodimer can comprise at least one additional domain chosen from nuclear localization signals (NLSs), plastid signal peptides, mitochondrial signal peptides, signal peptides capable of trafficking proteins to multiple subcellular locations, cell-penetrating, translocation domains and marker domains, as detailed above. In any of the above-described embodiments, one or both of the Cms1 polypeptides can be modified such that endonuclease activity of the polypeptide is eliminated or modified.

The heterodimer can also comprise one fusion protein and an additional protein. For example, the additional protein can be a nuclease. In one embodiment, the nuclease is a zinc finger nuclease. A zinc finger nuclease comprises a zinc finger DNA binding domain and a cleavage domain. A zinc finger recognizes and binds three (3) nucleotides. A zinc finger DNA binding domain can comprise from about three zinc fingers to about seven zinc fingers. The zinc finger DNA binding domain can be derived from a naturally occurring protein or it can be engineered. See, for example, Beerli et al. (2002) *Nat. Biotechnol.* 20:135-141; Pabo et al. (2001) *Ann. Rev. Biochem.* 70:313-340; Isalan et al. (2001) *Nat. Biotechnol.* 19:656-660; Segal et al. (2001) *Curr. Opin. Biotechnol.* 12:632-637; Choo et al. (2000) *Curr. Opin. Struct. Biol.* 10:411-416; Zhang et al. (2000) *J. Biol. Chem.* 275(43):33850-33860; Doyon et al. (2008) *Nat. Biotechnol.* 26:702-708; and Santiago et al. (2008) *Proc. Natl. Acad. Sci. USA* 105:5809-5814. The cleavage domain of the zinc finger nuclease can be any cleavage domain detailed herein. In some embodiments, the zinc finger nuclease can comprise at least one additional domain chosen from nuclear localization signals, plastid signal peptides, mitochondrial signal peptides, signal peptides capable of trafficking proteins to multiple subcellular locations, cell-penetrating or translocation domains, which are detailed herein.

In certain embodiments, any of the fusion proteins detailed above or a dimer comprising at least one fusion protein may be part of a protein-RNA complex comprising at least one guide RNA. A guide RNA interacts with the Cms1 polypeptide of the fusion protein to direct the fusion protein to a specific target site, wherein the 5' end of the guide RNA base pairs with a specific protospacer sequence.

III. Nucleic Acids Encoding Cms1 Polypeptides or Fusion Proteins

Nucleic acids encoding any of the Cms1 polypeptides or fusion proteins described herein are provided. The nucleic acid can be RNA or DNA. Examples of polynucleotides that encode Cms1 polypeptides are set forth in SEQ ID NOs: 16-19, 24-27, 70-146, 174-176, 212-215, and 255-287. In one embodiment, the nucleic acid encoding the Cms1 polypeptide or fusion protein is mRNA. The mRNA can be 5' capped and/or 3' polyadenylated. In another embodiment, the nucleic acid encoding the Cms1 polypeptide or fusion protein is DNA. The DNA can be present in a vector.

Nucleic acids encoding the Cms1 polypeptide or fusion proteins can be codon optimized for efficient translation into protein in the plant cell of interest. Programs for codon optimization are available in the art (e.g., OPTIMIZER at genomes.urv.es/OPTIMIZER; OptimumGene™ from GenScript at www.genscript.com/codon_opt.html).

In certain embodiments, DNA encoding the Cms1 polypeptide or fusion protein can be operably linked to at least one promoter sequence. The DNA coding sequence can be operably linked to a promoter control sequence for expression in a host cell of interest. In some embodiments, the host cell is a plant cell. "Operably linked" is intended to mean a functional linkage between two or more elements. For example, an operable linkage between a promoter and a coding region of interest (e.g., region coding for a Cms1 polypeptide or guide RNA) is a functional link that allows for expression of the coding region of interest. Operably linked elements may be contiguous or non-contiguous. When used to refer to the joining of two protein coding regions, by operably linked is intended that the coding regions are in the same reading frame.

The promoter sequence can be constitutive, regulated, growth stage-specific, or tissue-specific. It is recognized that different applications can be enhanced by the use of different promoters in the nucleic acid molecules to modulate the timing, location and/or level of expression of the Cms1 polypeptide and/or guide RNA. Such nucleic acid molecules may also contain, if desired, a promoter regulatory region (e.g., one conferring inducible, constitutive, environmentally- or developmentally-regulated, or cell- or tissue-specific/selective expression), a transcription initiation start site, a ribosome binding site, an RNA processing signal, a transcription termination site, and/or a polyadenylation signal.

In some embodiments, the nucleic acid molecules provided herein can be combined with constitutive, tissue-preferred, developmentally-preferred or other promoters for expression in plants. Examples of constitutive promoters functional in plant cells include the cauliflower mosaic virus (CaMV) 35S transcription initiation region, the 1'- or 2'-promoter derived from T-DNA of *Agrobacterium tumefaciens*, the ubiquitin 1 promoter, the Smas promoter, the cinnamyl alcohol dehydrogenase promoter (U.S. Pat. No. 5,683,439), the Nos promoter, the pEmu promoter, the rubisco promoter, the GRP1-8 promoter and other transcription initiation regions from various plant genes known to those of skill. If low level expression is desired, weak promoter(s) may be used. Weak constitutive promoters include, for example, the core promoter of the Rsyn7 promoter (WO 99/43838 and U.S. Pat. No. 6,072,050), the core 35S CaMV promoter, and the like. Other constitutive promoters include, for example, U.S. Pat. Nos. 5,608,149; 5,608,144; 5,604,121; 5,569,597; 5,466,785; 5,399,680; 5,268,463; and 5,608,142. See also, U.S. Pat. No. 6,177,611, herein incorporated by reference.

Examples of inducible promoters are the Adh1 promoter which is inducible by hypoxia or cold stress, the Hsp70 promoter which is inducible by heat stress, the PPDK promoter and the pepcarboxylase promoter which are both inducible by light. Also useful are promoters which are chemically inducible, such as the In2-2 promoter which is safener induced (U.S. Pat. No. 5,364,780), the ERE promoter which is estrogen induced, and the Axig1 promoter which is auxin induced and tapetum specific but also active in callus (PCT US01/22169).

Examples of promoters under developmental control in plants include promoters that initiate transcription preferentially in certain tissues, such as leaves, roots, fruit, seeds, or flowers. A "tissue specific" promoter is a promoter that initiates transcription only in certain tissues. Unlike constitutive expression of genes, tissue-specific expression is the result of several interacting levels of gene regulation. As such, promoters from homologous or closely related plant species can be preferable to use to achieve efficient and reliable expression of transgenes in particular tissues. In some embodiments, the expression comprises a tissue-preferred promoter. A "tissue preferred" promoter is a promoter that initiates transcription preferentially, but not necessarily entirely or solely in certain tissues.

In some embodiments, the nucleic acid molecules encoding a Cms1 polypeptide and/or guide RNA comprise a cell type specific promoter. A "cell type specific" promoter is a promoter that primarily drives expression in certain cell types in one or more organs. Some examples of plant cells in which cell type specific promoters functional in plants may be primarily active include, for example, BETL cells, vascular cells in roots, leaves, stalk cells, and stem cells. The nucleic acid molecules can also include cell type preferred promoters. A "cell type preferred" promoter is a promoter that primarily drives expression mostly, but not necessarily entirely or solely in certain cell types in one or more organs. Some examples of plant cells in which cell type preferred promoters functional in plants may be preferentially active include, for example, BETL cells, vascular cells in roots, leaves, stalk cells, and stem cells. The nucleic acid molecules described herein can also comprise seed-preferred promoters. In some embodiments, the seed-preferred promoters have expression in embryo sac, early embryo, early endosperm, aleurone, and/or basal endosperm transfer cell layer (BETL).

Examples of seed-preferred promoters include, but are not limited to, 27 kD gamma zein promoter and waxy promoter, Boronat, A. et al. (1986) *Plant Sci.* 47:95-102; Reina, M. et al. *Nucl. Acids Res.* 18(21):6426; and Kloesgen, R. B. et al. (1986) *Mol. Gen. Genet.* 203:237-244. Promoters that express in the embryo, pericarp, and endosperm are disclosed in U.S. Pat. No. 6,225,529 and PCT publication WO 00/12733. The disclosures for each of these are incorporated herein by reference in their entirety.

Promoters that can drive gene expression in a plant seed-preferred manner with expression in the embryo sac, early embryo, early endosperm, aleurone and/or basal endosperm transfer cell layer (BETL) can be used in the compositions and methods disclosed herein. Such promoters include, but are not limited to, promoters that are naturally linked to *Zea mays* early endosperm 5 gene, *Zea mays* early endosperm 1 gene, *Zea mays* early endosperm 2 gene, GRMZM2G124663, GRMZM2G006585, GRMZM2G120008, GRMZM2G157806, GRMZM2G176390, GRMZM2G472234, GRMZM2G138727, *Zea mays* CLAVATA1, *Zea mays* MRP1, *Oryza sativa* PR602, *Oryza sativa* PR9a, *Zea mays* BET1, *Zea mays* BETL-2, *Zea mays* BETL-3, *Zea mays* BETL-4, *Zea mays* BETL-9, *Zea mays* BETL-10, *Zea mays* MEG1, *Zea mays* TCCR1, *Zea mays* ASP1, *Oryza sativa* ASP1, *Triticum durum* PR60, *Triticum durum* PR91, *Triticum durum* GL7, AT3G10590, AT4G18870, AT4G21080, AT5G23650, AT3G05860, AT5G42910, AT2G26320, AT3G03260, AT5G26630, AtIPT4, AtIPT8, AtLEC2, LFAH12. Additional such promoters are described in U.S. Pat. Nos. 7,803,990, 8,049,000, 7,745,697, 7,119,251, 7,964,770, 7,847,160, 7,700,836, U.S. Patent Application Publication Nos. 20100313301, 20090049571, 20090089897, 20100281569, 20100281570, 20120066795, 20040003427; PCT Publication Nos. WO/1999/050427, WO/2010/129999, WO/2009/094704, WO/2010/019996 and WO/2010/147825, each of which is herein incorporated by reference in its entirety for all purposes. Functional variants or functional fragments of the promoters described herein can also be operably linked to the nucleic acids disclosed herein.

Chemical-regulated promoters can be used to modulate the expression of a gene through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena et al. (1991) *Proc. Natl. Acad. Sci. USA* 88:10421-10425 and McNellis et al. (1998) *Plant J.* 14(2):247-257) and tetracycline-inducible and tetracycline-repressible promoters (see, for example, Gatz et al. (1991)*Mol. Gen. Genet.* 227:229-237, and U.S. Pat. Nos. 5,814,618 and 5,789,156), herein incorporated by reference.

Tissue-preferred promoters can be utilized to target enhanced expression of an expression construct within a particular tissue. In certain embodiments, the tissue-preferred promoters may be active in plant tissue. Tissue-preferred promoters are known in the art. See, for example, Yamamoto et al. (1997) *Plant* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2): 157-168; Rinehart et al. (1996) *Plant Physiol.* 112(3): 1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-preferred promoters are known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590. In addition, the promoters of cab and rubisco can also be used. See, for example, Simpson et al. (1958) *EMBO J* 4:2723-2729 and Timko et al. (1988) *Nature* 318:57-58.

Root-preferred promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agrobacterium tumefaciens*); and Miao et al. (1991) *Plant Cell* 3(1):11-22 (full-length cDNA clone encoding cytosolic glutamine synthetase (GS), which is expressed in roots and root nodules of soybean). See also Bogusz et al. (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi (1991) describe their analysis of the promoters of the highly expressed rolC and rolD root-inducing genes of *Agrobacterium rhizogenes* (see Plant Science (Limerick) 79(1):69-76). They concluded that enhancer and tissue-preferred DNA determinants are dissociated in those promoters. Teeri et al. (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see *EMBO J.* 8(2): 343-350). The TR1' gene, fused to nptII (neomycin phosphotransferase II) showed similar characteristics. Additional root-preferred promoters include the VfENOD-GRP3 gene promoter (Kuster et al. (1995) *Plant Mol. Biol.* 29(4):759-772); and roM promoter (Capana et al. (1994) *Plant Mol. Biol.* 25(4):681-691. See also U.S. Pat. Nos. 5,837,876; 5,750,386; 5,633,363; 5,459,252; 5,401,836; 5,110,732; and 5,023,179. The phaseolin gene (Murai et al. (1983) *Science* 23:476-482 and Sengopta-Gopalen et al. (1988) *PNAS* 82:3320-3324. The promoter sequence can be wild type or it can be modified for more efficient or efficacious expression.

The nucleic acid sequences encoding the Cms1 polypeptide or fusion protein can be operably linked to a promoter sequence that is recognized by a phage RNA polymerase for in vitro mRNA synthesis. In such embodiments, the in vitro-transcribed RNA can be purified for use in the methods of genome modification described herein. For example, the promoter sequence can be a T7, T3, or SP6 promoter sequence or a variation of a T7, T3, or SP6 promoter sequence. In some embodiments, the sequence encoding the Cms1 polypeptide or fusion protein can be operably linked to a promoter sequence for in vitro expression of the Cms1 polypeptide or fusion protein in plant cells. In such embodiments, the expressed protein can be purified for use in the methods of genome modification described herein.

In certain embodiments, the DNA encoding the Cms1 polypeptide or fusion protein also can be linked to a polyadenylation signal (e.g., SV40 polyA signal and other signals functional in the cells of interest) and/or at least one transcriptional termination sequence. Additionally, the sequence encoding the Cms1 polypeptide or fusion protein also can be linked to a sequence encoding at least one nuclear localization signal, at least one plastid signal peptide, at least one mitochondrial signal peptide, at least one signal peptide capable of trafficking proteins to multiple subcellular locations, at least one cell-penetrating domain, and/or at least one marker domain, described elsewhere herein.

The DNA encoding the Cms1 polypeptide or fusion protein can be present in a vector. Suitable vectors include plasmid vectors, phagemids, cosmids, artificial/mini-chromosomes, transposons, and viral vectors (e.g., lentiviral vectors, adeno-associated viral vectors, etc.). In one embodiment, the DNA encoding the Cms1 polypeptide or fusion protein is present in a plasmid vector. Non-limiting examples of suitable plasmid vectors include pUC, pBR322, pET, pBluescript, pCAMBIA, and variants thereof. The vector can comprise additional expression control sequences (e.g., enhancer sequences, Kozak sequences, polyadenylation sequences, transcriptional termination sequences, etc.), selectable marker sequences (e.g., antibiotic resistance genes), origins of replication, and the like. Additional information can be found in "Current Protocols in Molecular Biology" Ausubel et al., John Wiley & Sons, New York, 2003 or "Molecular Cloning: A Laboratory Manual" Sambrook & Russell, Cold Spring Harbor Press, Cold Spring Harbor, N.Y., 3rd edition, 2001.

In some embodiments, the expression vector comprising the sequence encoding the Cms1 polypeptide or fusion protein can further comprise a sequence encoding a guide RNA. The sequence encoding the guide RNA can be operably linked to at least one transcriptional control sequence for expression of the guide RNA in the plant or plant cell of interest. For example, DNA encoding the guide RNA can be operably linked to a promoter sequence that is recognized by RNA polymerase III (Pol III). Examples of suitable Pol III promoters include, but are not limited to, mammalian U6, U3, H1, and 7SL RNA promoters and rice U6 and U3 promoters.

IV. Methods for Modifying a Nucleotide Sequence in a Genome

Methods are provided herein for modifying a nucleotide sequence of a genome. Non-limiting examples of genomes include cellular, nuclear, organellar, plasmid, and viral genomes. The methods comprise introducing into a genome host (e.g., a cell or organelle) one or more DNA-targeting polynucleotides such as a DNA-targeting RNA ("guide RNA," "gRNA," "CRISPR RNA," or "crRNA") or a DNA polynucleotide encoding a DNA-targeting RNA, wherein the DNA-targeting polynucleotide comprises: (a) a first segment comprising a nucleotide sequence that is complementary to a sequence in the target DNA; and (b) a second segment that interacts with a Cms1 polypeptide and also introducing to the genome host a Cms1 polypeptide, or a polynucleotide encoding a Cms1 polypeptide, wherein the a Cms1 polypeptide comprises: (a) a polynucleotide-binding portion that interacts with the gRNA or other DNA-targeting polynucleotide; and (b) an activity portion that exhibits site-directed enzymatic activity. The genome host can then be cultured under conditions in which the Cms1 polypeptide is expressed and cleaves the nucleotide sequence that is targeted by the gRNA. It is noted that the system described herein does not require the addition of exogenous $Mg^{2+}$ or any other ions. Finally, a genome host comprising the modified nucleotide sequence can be selected.

The methods disclosed herein comprise introducing into a genome host at least one Cms1 polypeptide or a nucleic acid encoding at least one Cms1 polypeptide, as described herein. In some embodiments, the Cms1 polypeptide can be introduced into the genome host as an isolated protein. In such embodiments, the Cms1 polypeptide can further comprise at least one cell-penetrating domain, which facilitates cellular uptake of the protein. In some embodiments, the Cms1 polypeptide can be introduced into the genome host as a nucleoprotein in complex with a guide polynucleotide (for instance, as a ribonucleoprotein in complex with a guide RNA). In other embodiments, the Cms1 polypeptide can be introduced into the genome host as an mRNA molecule that encodes the Cms1 polypeptide. In still other embodiments, the Cms1 polypeptide can be introduced into the genome host as a DNA molecule comprising an open reading frame that encodes the Cms1 polypeptide. In general, DNA sequences encoding the Cms1 polypeptide or fusion protein described herein are operably linked to a promoter sequence that will function in the genome host. The DNA sequence can be linear, or the DNA sequence can be part of a vector. In still other embodiments, the Cms1 polypeptide or fusion protein can be introduced into the genome host as an RNA-protein complex comprising the guide RNA or a fusion protein and the guide RNA.

In certain embodiments, mRNA encoding the Cms1 polypeptide may be targeted to an organelle (e.g., plastid or mitochondria). In certain embodiments, mRNA encoding one or more guide RNAs may be targeted to an organelle (e.g., plastid or mitochondria). In certain embodiments, mRNA encoding the Cms1 polypeptide and one or more guide RNAs may be targeted to an organelle (e.g., plastid or mitochondria). Methods for targeting mRNA to organelles are known in the art (see, e.g., U.S. Patent Application 2011/0296551; U.S. Patent Application 2011/0321187; Gómez and Pallás (2010) PLoS One 5:e12269), and are incorporated herein by reference.

In certain embodiments, DNA encoding the Cms1 polypeptide can further comprise a sequence encoding a guide RNA. In general, each of the sequences encoding the Cms1 polypeptide and the guide RNA is operably linked to one or more appropriate promoter control sequences that allow expression of the Cms1 polypeptide and the guide RNA, respectively, in the genome host. The DNA sequence encoding the Cms1 polypeptide and the guide RNA can further comprise additional expression control, regulatory, and/or processing sequence(s). The DNA sequence encoding the Cms1 polypeptide and the guide RNA can be linear or can be part of a vector.

Methods described herein further can also comprise introducing into a genome host at least one guide RNA or DNA encoding at least one polynucleotide such as a guide RNA. A guide RNA interacts with the Cms1 polypeptide to direct the Cms1 polypeptide to a specific target site, at which site the guide RNA base pairs with a specific DNA sequence in the targeted site. Guide RNAs can comprise three regions: a first region that is complementary to the target site in the targeted DNA sequence, a second region that forms a stem loop structure, and a third region that remains essentially single-stranded. The first region of each guide RNA is different such that each guide RNA guides a Cms1 polypeptide to a specific target site. The second and third regions of each guide RNA can be the same in all guide RNAs.

One region of the guide RNA is complementary to a sequence (i.e., protospacer sequence) at the target site in the targeted DNA such that the first region of the guide RNA can base pair with the target site. In various embodiments, the first region of the guide RNA can comprise from about 8 nucleotides to more than about 30 nucleotides. For example, the region of base pairing between the first region of the guide RNA and the target site in the nucleotide sequence can be about 8, about 9, about 10, about 11, about 12, about 13, about 14, about 15, about 16, about 17, about 18, about 19, about 20, about 22, about 23, about 24, about 25, about 27, about 30 or more than 30 nucleotides in length. In an exemplary embodiment, the first region of the guide RNA is about 23, 24, or 25 nucleotides in length. The guide RNA also can comprise a second region that forms a secondary structure. In some embodiments, the secondary structure comprises a stem or hairpin. The length of the stem can vary. For example, the stem can range from about 5, to about 6, to about 10, to about 15, to about 20, to about 25 base pairs in length. The stem can comprise one or more bulges of 1 to about 10 nucleotides. In some preferred embodiments, the hairpin structure comprises the sequence $UCUACN_{3-5}$ GUAGAU (SEQ ID NOs:312-314, encoded by SEQ ID NOs:315-317), with "UCUAC" and "GUAGA" base-pairing to form the stem. "$N_{3-5}$" indicates 3, 4, or 5 nucleotides. Thus, the overall length of the second region can range from about 14 to about 25 nucleotides in length. In certain embodiments, the loop is about 3, 4, or 5 nucleotides in length and the stem comprises about 5, 6, 7, 8, 9, or 10 base pairs.

The guide RNA can also comprise a third region that remains essentially single-stranded. Thus, the third region has no complementarity to any nucleotide sequence in the cell of interest and has no complementarity to the rest of the guide RNA. The length of the third region can vary. In general, the third region is more than about 4 nucleotides in length. For example, the length of the third region can range from about 5 to about 60 nucleotides in length. The combined length of the second and third regions (also called the universal or scaffold region) of the guide RNA can range from about 30 to about 120 nucleotides in length. In one aspect, the combined length of the second and third regions of the guide RNA range from about 40 to about 45 nucleotides in length.

In some embodiments, the guide RNA comprises a single molecule comprising all three regions. In other embodiments, the guide RNA can comprise two separate molecules. The first RNA molecule can comprise the first region of the guide RNA and one half of the "stem" of the second region of the guide RNA. The second RNA molecule can comprise the other half of the "stem" of the second region of the guide RNA and the third region of the guide RNA. Thus, in this embodiment, the first and second RNA molecules each contain a sequence of nucleotides that are complementary to one another. For example, in one embodiment, the first and second RNA molecules each comprise a sequence (of about 6 to about 25 nucleotides) that base pairs to the other sequence to form a functional guide RNA. In specific embodiments, the guide RNA is a single molecule (i.e., crRNA) that interacts with the target site in the chromosome and the Cms1 polypeptide without the need for a second guide RNA (i.e., a tracrRNA).

In certain embodiments, the guide RNA can be introduced into the genome host as an RNA molecule. The RNA molecule can be transcribed in vitro. Alternatively, the RNA molecule can be chemically synthesized. In other embodiments, the guide RNA can be introduced into the genome host as a DNA molecule. In such cases, the DNA encoding the guide RNA can be operably linked to one or more promoter sequences for expression of the guide RNA in the genome host. For example, the RNA coding sequence can be operably linked to a promoter sequence that is recognized by RNA polymerase III (Pol III).

The DNA molecule encoding the guide RNA can be linear or circular. In some embodiments, the DNA sequence encoding the guide RNA can be part of a vector. Suitable vectors include plasmid vectors, phagemids, cosmids, artificial/mini-chromosomes, transposons, and viral vectors. In an exemplary embodiment, the DNA encoding the guide RNA is present in a plasmid vector. Non-limiting examples of suitable plasmid vectors include pUC, pBR322, pET, pBluescript, pCAMBIA, and variants thereof. The vector can comprise additional expression control sequences (e.g., enhancer sequences, Kozak sequences, polyadenylation sequences, transcriptional termination sequences, etc.), selectable marker sequences (e.g., antibiotic resistance genes), origins of replication, and the like.

In embodiments in which both the Cms1 polypeptide and the guide RNA are introduced into the genome host as DNA molecules, each can be part of a separate molecule (e.g., one vector containing Cms1 polypeptide or fusion protein coding sequence and a second vector containing guide RNA coding sequence) or both can be part of the same molecule (e.g., one vector containing coding (and regulatory) sequence for both the Cms1 polypeptide or fusion protein and the guide RNA).

A Cms1 polypeptide in conjunction with a guide RNA is directed to a target site in a genome host, wherein the Cms1 polypeptide introduces a double-stranded break in the targeted DNA. The target site has no sequence limitation except that the sequence is immediately preceded (upstream) by a consensus sequence. This consensus sequence is also known as a protospacer adjacent motif (PAM). Examples of PAM sequences include, but are not limited to, TTTN, NTTN, TTTV, and NTTV (wherein N is defined as any nucleotide and V is defined as A, G, or C). It is well-known in the art that a suitable PAM sequence must be located at the correct location relative to the targeted DNA sequence to allow the Cms1 nuclease to produce the desired double-stranded break. For all Cms1 nucleases characterized to date, the PAM sequence has been located immediately 5' to the targeted DNA sequence. The PAM site requirements for a given Cms1 nuclease cannot at present be predicted computationally, and instead must be determined experimentally using methods available in the art (Zetsche et al. (2015) *Cell* 163:759-771; Marshall et al. (2018) *Mol Cell* 69:146-157). It is well-known in the art that PAM sequence specificity for a given nuclease enzyme is affected by enzyme concentration (Karvelis et al. (2015) *Genome Biol* 16:253). Thus, modulating the concentrations of Cms1 protein delivered to the cell or in vitro system of interest represents a way to alter the PAM site or sites associated with that Cms1 enzyme. Modulating Cms1 protein concentration in the system of interest may be achieved, for instance, by altering the promoter used to express the Cms1-encoding gene, by altering the concentration of ribonucleoprotein delivered to the cell or in vitro system, or by adding or removing introns that may play a role in modulating gene expression levels. As detailed herein, the first region of the guide RNA is complementary to the protospacer of the target sequence. Typically, the first region of the guide RNA is about 19 to 21 nucleotides in length.

The target site can be in the coding region of a gene, in an intron of a gene, in a control region of a gene, in a non-coding region between genes, etc. The gene can be a protein coding gene or an RNA coding gene. The gene can be any gene of interest as described herein.

In some embodiments, the methods disclosed herein further comprise introducing at least one donor polynucleotide into a genome host. A donor polynucleotide comprises at least one donor sequence. In some aspects, a donor sequence of the donor polynucleotide corresponds to an endogenous or native sequence found in the targeted DNA. For example, the donor sequence can be essentially identical to a portion of the DNA sequence at or near the targeted site, but which comprises at least one nucleotide change. Thus, the donor sequence can comprise a modified version of the wild type sequence at the targeted site such that, upon integration or exchange with the native sequence, the sequence at the targeted location comprises at least one nucleotide change. For example, the change can be an insertion of one or more nucleotides, a deletion of one or more nucleotides, a substitution of one or more nucleotides, or combinations thereof. As a consequence of the integration of the modified sequence, the genome host can produce a modified gene product from the targeted chromosomal sequence.

The donor sequence of the donor polynucleotide can alternatively correspond to an exogenous sequence. As used herein, an "exogenous" sequence refers to a sequence that is not native to the genome host, or a sequence whose native location in the genome host is in a different location. For example, the exogenous sequence can comprise a protein coding sequence, which can be operably linked to an exogenous promoter control sequence such that, upon integration into the genome, the genome host is able to express the protein coded by the integrated sequence. For example, the donor sequence can be any gene of interest, such as those encoding agronomically important traits as described elsewhere herein. Alternatively, the exogenous sequence can be integrated into the targeted DNA sequence such that its expression is regulated by an endogenous promoter control sequence. In other iterations, the exogenous sequence can be a transcriptional control sequence, another expression control sequence, or an RNA coding sequence. Integration of an exogenous sequence into a targeted DNA sequence is termed a "knock in." The donor sequence can vary in length from several nucleotides to hundreds of nucleotides to hundreds of thousands of nucleotides.

In some embodiments, the donor sequence in the donor polynucleotide is flanked by an upstream sequence and a downstream sequence, which have substantial sequence identity to sequences located upstream and downstream, respectively, of the targeted site. Because of these sequence similarities, the upstream and downstream sequences of the donor polynucleotide permit homologous recombination between the donor polynucleotide and the targeted sequence such that the donor sequence can be integrated into (or exchanged with) the targeted DNA sequence.

The upstream sequence, as used herein, refers to a nucleic acid sequence that shares substantial sequence identity with a DNA sequence upstream of the targeted site. Similarly, the downstream sequence refers to a nucleic acid sequence that shares substantial sequence identity with a DNA sequence downstream of the targeted site. As used herein, the phrase "substantial sequence identity" refers to sequences having at least about 75% sequence identity. Thus, the upstream and downstream sequences in the donor polynucleotide can have about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with sequence upstream or downstream to the targeted site. In an exemplary embodiment, the upstream and downstream sequences in the donor polynucleotide can have about 95% or 100% sequence identity with nucleotide sequences upstream or downstream to the targeted site. In one embodiment, the upstream sequence shares substantial sequence identity with a nucleotide sequence located immediately upstream of the targeted site (i.e., adjacent to the targeted site). In other embodiments, the upstream sequence shares substantial sequence identity with a nucleotide sequence that is located within about one hundred (100) nucleotides upstream from the targeted site. Thus, for example, the upstream sequence can share substantial sequence identity with a nucleotide sequence that is located about 1 to about 20, about 21 to about 40, about 41 to about 60, about 61 to about 80, or about 81 to about 100 nucleotides upstream from the targeted site. In one embodiment, the downstream sequence shares substantial sequence identity with a nucleotide sequence located immediately downstream of the targeted site (i.e., adjacent to the targeted site). In other embodiments, the downstream sequence shares substantial sequence identity with a nucleotide sequence that is located within about one hundred (100) nucleotides downstream from the targeted site. Thus, for example, the downstream sequence can share substantial sequence identity with a nucleotide sequence that is located about 1 to about 20, about 21 to about 40, about 41 to about 60, about 61 to about 80, or about 81 to about 100 nucleotides downstream from the targeted site.

Each upstream or downstream sequence can range in length from about 20 nucleotides to about 5000 nucleotides. In some embodiments, upstream and downstream sequences can comprise about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2800, 3000, 3200, 3400, 3600, 3800, 4000, 4200, 4400, 4600, 4800, or 5000 nucleotides. In exemplary embodiments, upstream and downstream sequences can range in length from about 50 to about 1500 nucleotides.

Donor polynucleotides comprising the upstream and downstream sequences with sequence similarity to the targeted nucleotide sequence can be linear or circular. In embodiments in which the donor polynucleotide is circular, it can be part of a vector. For example, the vector can be a plasmid vector.

In certain embodiments, the donor polynucleotide can additionally comprise at least one targeted cleavage site that is recognized by the Cms1 polypeptide. The targeted cleavage site added to the donor polynucleotide can be placed upstream or downstream or both upstream and downstream of the donor sequence. For example, the donor sequence can be flanked by targeted cleavage sites such that, upon cleavage by the Cms1 polypeptide, the donor sequence is flanked by overhangs that are compatible with those in the nucleotide sequence generated upon cleavage by the Cms1 polypeptide. Accordingly, the donor sequence can be ligated with the cleaved nucleotide sequence during repair of the double stranded break by a non-homologous repair process. Generally, donor polynucleotides comprising the targeted cleavage site(s) will be circular (e.g., can be part of a plasmid vector).

The donor polynucleotide can be a linear molecule comprising a short donor sequence with optional short overhangs that are compatible with the overhangs generated by the Cms1 polypeptide. In such embodiments, the donor sequence can be ligated directly with the cleaved chromosomal sequence during repair of the double-stranded break. In some instances, the donor sequence can be less than about 1,000, less than about 500, less than about 250, or less than about 100 nucleotides. In certain cases, the donor polynucleotide can be a linear molecule comprising a short donor sequence with blunt ends. In other iterations, the donor polynucleotide can be a linear molecule comprising a short donor sequence with 5' and/or 3' overhangs. The overhangs can comprise 1, 2, 3, 4, or 5 nucleotides.

In some embodiments, the donor polynucleotide will be DNA. The DNA may be single-stranded or double-stranded and/or linear or circular. The donor polynucleotide may be a DNA plasmid, a bacterial artificial chromosome (BAC), a yeast artificial chromosome (YAC), a viral vector, a linear piece of DNA, a PCR fragment, a naked nucleic acid, or a nucleic acid complexed with a delivery vehicle such as a liposome or poloxamer. In certain embodiments, the donor polynucleotide comprising the donor sequence can be part of a plasmid vector. In any of these situations, the donor polynucleotide comprising the donor sequence can further comprise at least one additional sequence.

In some embodiments, the method can comprise introducing one Cms1 polypeptide (or encoding nucleic acid) and one guide RNA (or encoding DNA) into a genome host, wherein the Cms1 polypeptide introduces one double-stranded break in the targeted DNA. In embodiments in which an optional donor polynucleotide is not present, the double-stranded break in the nucleotide sequence can be repaired by a non-homologous end-joining (NHEJ) repair process. Because NHEJ is error-prone, deletions of at least one nucleotide, insertions of at least one nucleotide, substitutions of at least one nucleotide, or combinations thereof can occur during the repair of the break. Accordingly, the targeted nucleotide sequence can be modified or inactivated. For example, a single nucleotide change (SNP) can give rise to an altered protein product, or a shift in the reading frame of a coding sequence can inactivate or "knock out" the sequence such that no protein product is made. In embodiments in which the optional donor polynucleotide is present, the donor sequence in the donor polynucleotide can be exchanged with or integrated into the nucleotide sequence at the targeted site during repair of the double-stranded break. For example, in embodiments in which the donor sequence is flanked by upstream and downstream sequences having substantial sequence identity with upstream and downstream sequences, respectively, of the targeted site in the nucleotide sequence, the donor sequence can be exchanged with or integrated into the nucleotide sequence at the targeted site during repair mediated by homology-directed repair process. Alternatively, in embodiments in which the donor sequence is flanked by compatible overhangs (or the compatible overhangs are generated in situ by the Cms1 polypeptide) the donor sequence can be ligated directly with the cleaved nucleotide sequence by a non-homologous repair process during repair of the double-stranded break. Exchange or integration of the donor sequence into the nucleotide sequence modifies the targeted nucleotide sequence or introduces an exogenous sequence into the targeted nucleotide sequence.

The methods disclosed herein can also comprise introducing one or more Cms1 polypeptides (or encoding nucleic acids) and two guide polynucleotides (or encoding DNAs) into a genome host, wherein the Cms1 polypeptides introduce two double-stranded breaks in the targeted nucleotide sequence. The two breaks can be within several base pairs, within tens of base pairs, or can be separated by many thousands of base pairs. In embodiments in which an optional donor polynucleotide is not present, the resultant double-stranded breaks can be repaired by a non-homologous repair process such that the sequence between the two cleavage sites is lost and/or deletions of at least one nucleotide, insertions of at least one nucleotide, substitutions of at least one nucleotide, or combinations thereof can occur during the repair of the break(s). In embodiments in which an optional donor polynucleotide is present, the donor sequence in the donor polynucleotide can be exchanged with or integrated into the targeted nucleotide sequence during repair of the double-stranded breaks by either a homology-based repair process (e.g., in embodiments in which the donor sequence is flanked by upstream and downstream sequences having substantial sequence identity with upstream and downstream sequences, respectively, of the targeted sites in the nucleotide sequence) or a non-homologous repair process (e.g., in embodiments in which the donor sequence is flanked by compatible overhangs).

A. Methods for Modifying a Nucleotide Sequence in a Plant Genome

Plant cells possess nuclear, plastid, and mitochondrial genomes. The compositions and methods of the present invention may be used to modify the sequence of the nuclear, plastid, and/or mitochondrial genome, or may be used to modulate the expression of a gene or genes encoded by the nuclear, plastid, and/or mitochondrial genome. Accordingly, by "chromosome" or "chromosomal" is intended the nuclear, plastid, or mitochondrial genomic DNA. "Genome" as it applies to plant cells encompasses not only chromosomal DNA found within the nucleus, but organelle DNA found within subcellular components (e.g., mitochondria or plastids) of the cell. Any nucleotide sequence of interest in a plant cell, organelle, or embryo can be modified using the methods described herein. In specific embodiments, the methods disclosed herein are used to modify a nucleotide sequence encoding an agronomically important trait, such as a plant hormone, plant defense protein, a nutrient transport protein, a biotic association protein, a desirable input trait, a desirable output trait, a stress resistance gene, a disease/pathogen resistance gene, a male sterility, a developmental gene, a regulatory gene, a gene involved in photosynthesis, a DNA repair gene, a transcriptional regulatory gene or any other polynucleotide and/or polypeptide of interest. Agronomically important traits such as oil, starch, and protein content can also be modified. Modifications include increasing content of oleic acid, saturated and unsaturated oils, increasing levels of lysine and sulfur, providing essential amino acids, and also modification of starch. Hordothionin protein modifications are described in U.S. Pat. Nos. 5,703,049, 5,885,801, 5,885, 802, and 5,990,389, herein incorporated by reference. Another example is lysine and/or sulfur rich seed protein encoded by the soybean 2S albumin described in U.S. Pat. No. 5,850,016, and the chymotrypsin inhibitor from barley, described in Williamson et al. (1987) *Eur. J. Biochem.* 165:99-106, the disclosures of which are herein incorporated by reference.

The Cms1 polypeptide (or encoding nucleic acid), the guide RNA(s) (or encoding DNA), and the optional donor polynucleotide(s) can be introduced into a plant cell, organelle, or plant embryo by a variety of means, including transformation. Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) *Biotechniques* 4:320-334), electroporation (Riggs et al. (1986) *Proc. Natl. Acad. Sci. USA* 83:5602-5606, *Agrobacterium*-mediated transformation (U.S. Pat. No. 5,563,055 and U.S. Pat. No. 5,981,840), direct gene transfer (Paszkowski et al. (1984) *EMBO J.* 3:2717-2722), and ballistic particle acceleration (see, for example, U.S. Pat. No. 4,945,050; U.S. Pat. No. 5,879,918; U.S. Pat. Nos. 5,886,244; and, 5,932,782; Tomes et al. (1995) in Plant Cell, Tissue, and Organ Culture: Fundamental Methods, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783; and, 5,324,646; Klein et al. (1988) *Plant Physiol.* 91:440-444 (maize); Fromm et al. (1990)

*Biotechnology* 8:833-839 (maize); Hooykaas-Van Slogteren et al. (1984) *Nature* (London) 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in The Experimental Manipulation of Ovule Tissues, ed. Chapman et al. (Longman, New York), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference. Site-specific genome editing of plant cells by biolistic introduction of a ribonucleoprotein comprising a nuclease and suitable guide RNA has been demonstrated (Svitashev et al (2016) *Nat Commun* 7:13274); these methods are herein incorporated by reference. "Stable transformation" is intended to mean that the nucleotide construct introduced into a plant integrates into the genome of the plant and is capable of being inherited by the progeny thereof. The nucleotide construct may be integrated into the nuclear, plastid, or mitochondrial genome of the plant. Methods for plastid transformation are known in the art (see, e.g., *Chloroplast Biotechnology: Methods and Protocols* (2014) Pal Maliga, ed. and U.S. Patent Application 2011/0321187), and methods for plant mitochondrial transformation have been described in the art (see, e.g., U.S. Patent Application 2011/0296551), herein incorporated by reference.

The cells that have been transformed may be grown into plants (i.e., cultured) in accordance with conventional ways. See, for example, McCormick et al. (1986) *Plant Cell Reports* 5:81-84. In this manner, the present invention provides transformed seed (also referred to as "transgenic seed") having a nucleic acid modification stably incorporated into their genome.

"Introduced" in the context of inserting a nucleic acid fragment (e.g., a recombinant DNA construct) into a cell, means "transfection" or "transformation" or "transduction" and includes reference to the incorporation of a nucleic acid fragment into a plant cell where the nucleic acid fragment may be incorporated into the genome of the cell (e.g., nuclear chromosome, plasmid, plastid chromosome or mitochondrial chromosome), converted into an autonomous replicon, or transiently expressed (e.g., transfected mRNA).

The present invention may be used for transformation of any plant species, including, but not limited to, monocots and dicots (i.e., monocotyledonous and dicotyledonous, respectively). Examples of plant species of interest include, but are not limited to, corn (*Zea mays*), Brassica sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), camelina (*Camelina sativa*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), quinoa (*Chenopodium quinoa*), chicory (*Cichorium intybus*), lettuce (*Lactuca sativa*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oil palm (*Elaeis guineensis*), poplar (*Populus* spp.), eucalyptus (*Eucalyptus* spp.), oats (*Avena sativa*), barley (*Hordeum vulgare*), vegetables, ornamentals, and conifers.

The Cms1 polypeptides (or encoding nucleic acid), the guide RNA(s) (or DNAs encoding the guide RNA), and the optional donor polynucleotide(s) can be introduced into the plant cell, organelle, or plant embryo simultaneously or sequentially. The ratio of the Cms1 polypeptides (or encoding nucleic acid) to the guide RNA(s) (or encoding DNA) generally will be about stoichiometric such that the two components can form an RNA-protein complex with the target DNA. In one embodiment, DNA encoding a Cms1 polypeptide and DNA encoding a guide RNA are delivered together within the plasmid vector.

The compositions and methods disclosed herein can be used to alter expression of genes of interest in a plant, such as genes involved in photosynthesis. Therefore, the expression of a gene encoding a protein involved in photosynthesis may be modulated as compared to a control plant. A "subject plant or plant cell" is one in which genetic alteration, such as a mutation, has been effected as to a gene of interest, or is a plant or plant cell which is descended from a plant or cell so altered and which comprises the alteration. A "control" or "control plant" or "control plant cell" provides a reference point for measuring changes in phenotype of the subject plant or plant cell. Thus, the expression levels are higher or lower than those in the control plant depending on the methods of the invention.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e. with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

While the invention is described in terms of transformed plants, it is recognized that transformed organisms of the invention also include plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

Derivatives of coding sequences can be made using the methods disclosed herein to increase the level of preselected amino acids in the encoded polypeptide. For example, the gene encoding the barley high lysine polypeptide (BHL) is derived from barley chymotrypsin inhibitor, U.S. application Ser. No. 08/740,682, filed Nov. 1, 1996, and WO 98/20133, the disclosures of which are herein incorporated by reference. Other proteins include methionine-rich plant proteins such as from sunflower seed (Lilley et al. (1989) *Proceedings of the World Congress on Vegetable Protein Utilization in Human Foods and Animal Feedstuffs*, ed. Applewhite (American Oil Chemists Society, Champaign, Ill.), pp. 497-502; herein incorporated by reference); corn (Pedersen et al. (1986) *J. Biol. Chem.* 261:6279; Kirihara et al. (1988) *Gene* 71:359; both of which are herein incorporated by reference); and rice (Musumura et al. (1989) *Plant Mol. Biol.* 12:123, herein incorporated by reference). Other agronomically important genes encode latex, Floury 2, growth factors, seed storage factors, and transcription factors.

The methods disclosed herein can be used to modify herbicide resistance traits including genes coding for resistance to herbicides that act to inhibit the action of acetolactate synthase (ALS), in particular the sulfonylurea-type herbicides (e.g., the acetolactate synthase (ALS) gene containing mutations leading to such resistance, in particular the S4 and/or Hra mutations), genes coding for resistance to herbicides that act to inhibit action of glutamine synthase, such as phosphinothricin or basta (e.g., the bar gene); glyphosate (e.g., the EPSPS gene and the GAT gene; see, for example, U.S. Publication No. 20040082770 and WO 03/092360); or other such genes known in the art. The bar gene encodes resistance to the herbicide basta, the nptII gene encodes resistance to the antibiotics kanamycin and geneticin, and the ALS-gene mutants encode resistance to the herbicide chlorsulfuron. Additional herbicide resistance traits are described for example in U.S. Patent Application 2016/0208243, herein incorporated by reference.

Sterility genes can also be modified and provide an alternative to physical detasseling. Examples of genes used in such ways include male tissue-preferred genes and genes with male sterility phenotypes such as QM, described in U.S. Pat. No. 5,583,210. Other genes include kinases and those encoding compounds toxic to either male or female gametophytic development. Additional sterility traits are described for example in U.S. Patent Application 2016/0208243, herein incorporated by reference.

The quality of grain can be altered by modifying genes encoding traits such as levels and types of oils, saturated and unsaturated, quality and quantity of essential amino acids, and levels of cellulose. In corn, modified hordothionin proteins are described in U.S. Pat. Nos. 5,703,049, 5,885,801, 5,885,802, and 5,990,389.

Commercial traits can also be altered by modifying a gene or that could increase for example, starch for ethanol production, or provide expression of proteins. Another important commercial use of modified plants is the production of polymers and bioplastics such as described in U.S. Pat. No. 5,602,321. Genes such as β-Ketothiolase, PHBase (polyhydroxyburyrate synthase), and acetoacetyl-CoA reductase (see Schubert et al. (1988) *J. Bacteriol.* 170:5837-5847) facilitate expression of polyhyroxyalkanoates (PHAs).

Exogenous products include plant enzymes and products as well as those from other sources including prokaryotes and other eukaryotes. Such products include enzymes, cofactors, hormones, and the like. The level of proteins, particularly modified proteins having improved amino acid distribution to improve the nutrient value of the plant, can be increased. This is achieved by the expression of such proteins having enhanced amino acid content.

The methods disclosed herein can also be used for insertion of heterologous genes and/or modification of native plant gene expression to achieve desirable plant traits. Such traits include, for example, disease resistance, herbicide tolerance, drought tolerance, salt tolerance, insect resistance, resistance against parasitic weeds, improved plant nutritional value, improved forage digestibility, increased grain yield, cytoplasmic male sterility, altered fruit ripening, increased storage life of plants or plant parts, reduced allergen production, and increased or decreased lignin content. Genes capable of conferring these desirable traits are disclosed in U.S. Patent Application 2016/0208243, herein incorporated by reference.

B. Methods for Modifying a Nucleotide Sequence in a Non-Plant Eukaryotic Genome

Methods are provided herein for modifying a nucleotide sequence of a non-plant eukaryotic cell, or non-plant eukaryotic organelle. In some embodiments, the non-plant eukaryotic cell is a mammalian cell. In particular embodiments, the non-plant eukaryotic cell is a non-human mammalian cell. The methods comprise introducing into a target cell or organelle a DNA-targeting RNA or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cms1 polypeptide and also introducing to the target cell or organelle a Cms1 polypeptide, or a polynucleotide encoding a Cms1 polypeptide, wherein the Cms1 polypeptide comprises: (a) an RNA-binding portion that interacts with the DNA-targeting RNA; and (b) an activity portion that exhibits site-directed enzymatic activity. The target cell or organelle can then be cultured under conditions in which the chimeric nuclease polypeptide is expressed and cleaves the nucleotide sequence. It is noted that the system described herein does not require the addition of exogenous $Mg^{2+}$ or any other ions. Finally, a non-plant eukaryotic cell or organelle comprising the modified nucleotide sequence can be selected.

In some embodiments, the method can comprise introducing one Cms1 polypeptide (or encoding nucleic acid) and one guide RNA (or encoding DNA) into a non-plant eukaryotic cell or organelle wherein the Cms1 polypeptide introduces one double-stranded break in the target nucleotide sequence of the nuclear or organellar chromosomal DNA. In some embodiments, the method can comprise introducing one Cms1 polypeptide (or encoding nucleic acid) and at least one guide RNA (or encoding DNA) into a non-plant eukaryotic cell or organelle wherein the Cms1 polypeptide introduces more than one double-stranded break (i.e., two, three, or more than three double-stranded breaks) in the target nucleotide sequence of the nuclear or organellar chromosomal DNA. In embodiments in which an optional donor polynucleotide is not present, the double-stranded break in the nucleotide sequence can be repaired by a non-homologous end-joining (NHEJ) repair process. Because NHEJ is error-prone, deletions of at least one nucleotide, insertions of at least one nucleotide, substitutions of at least one nucleotide, or combinations thereof can occur during the repair of the break. Accordingly, the targeted nucleotide sequence can be modified or inactivated. For example, a single nucleotide change (SNP) can give rise to an altered protein product, or a shift in the reading frame of a coding sequence can inactivate or "knock out" the sequence such that no protein product is made. In embodiments in which the optional donor polynucleotide is present, the donor sequence in the donor polynucleotide can be exchanged with or integrated into the nucleotide sequence at the targeted site during repair of the double-stranded break. For example, in embodiments in which the donor sequence is flanked by upstream and downstream sequences having substantial sequence identity with upstream and downstream sequences, respectively, of the targeted site in the nucleotide sequence of the non-plant eukaryotic cell or organelle, the donor sequence can be exchanged with or integrated into the nucleotide sequence at the targeted site during repair mediated by homology-directed repair process. Alternatively, in embodiments in which the donor sequence is flanked by compatible overhangs (or the compatible overhangs are generated in situ by the Cms1 polypeptide) the donor sequence can be ligated directly with the cleaved nucleotide sequence by a non-homologous repair process during repair of the double-stranded break. Exchange or integration of the donor sequence into the nucleotide sequence modifies the targeted nucleotide sequence or introduces an exogenous sequence into the targeted nucleotide sequence of the non-plant eukaryotic cell or organelle.

In some embodiments, the double-stranded breaks caused by the action of the Cms1 nuclease or nucleases are repaired in such a way that DNA is deleted from the chromosome of the non-plant eukaryotic cell or organelle. In some embodiments one base, a few bases (i.e., 2, 3, 4, 5, 6, 7, 8, 9, or 10 bases), or a large section of DNA (i.e., more than 10, more than 50, more than 100, or more than 500 bases) is deleted from the chromosome of the non-plant eukaryotic cell or organelle.

In some embodiments, the expression of non-plant eukaryotic genes may be modulated as a result of the double-stranded breaks caused by the Cms1 nuclease or nucleases. In some embodiments, the expression of non-plant eukaryotic genes may be modulated by variant Cms1 enzymes comprising a mutation that renders the Cms1 nuclease incapable of producing a double-stranded break. In some preferred embodiments, the variant Cms1 nuclease comprising a mutation that renders the Cms1 nuclease incapable of producing a double-stranded break may be fused to a transcriptional activation or transcriptional repression domain.

In some embodiments, a eukaryotic cell comprising mutations in its nuclear and/or organellar chromosomal DNA caused by the action of a Cms1 nuclease or nucleases is cultured to produce a eukaryotic organism. In some embodiments, a eukaryotic cell in which gene expression is modulated as a result of one or more Cms1 nucleases, or one or more variant Cms1 nucleases, is cultured to produce a eukaryotic organism. Methods for culturing non-plant eukaryotic cells to produce eukaryotic organisms are known in the art, for instance in U.S. Patent Applications 2016/0208243 and 2016/0138008, each herein incorporated by reference.

The present invention may be used for transformation of any eukaryotic species, including, but not limited to animals (including but not limited to mammals, insects, fish, birds, and reptiles), fungi, amoeba, and yeast.

Methods for the introduction of nuclease proteins, DNA or RNA molecules encoding nuclease proteins, guide RNAs or DNA molecules encoding guide RNAs, and optional donor sequence DNA molecules into non-plant eukaryotic cells or organelles are known in the art, for instance in U.S. Patent Application 2016/0208243, herein incorporated by reference. Exemplary genetic modifications to non-plant eukaryotic cells or organelles that may be of particular value for industrial applications are also known in the art, for instance in U.S. Patent Application 2016/0208243, herein incorporated by reference.

C. Methods for Modifying a Nucleotide Sequence in a Prokaryotic Genome

Methods are provided herein for modifying a nucleotide sequence of a prokaryotic (e.g., bacterial or archaeal) cell. The methods comprise introducing into a target cell a DNA-targeting RNA or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cms1 polypeptide and also introducing to the target cell a Cms1 polypeptide, or a polynucleotide encoding a Cms1 polypeptide, wherein the Cms1 polypeptide comprises: (a) an RNA-binding portion that interacts with the DNA-targeting RNA; and (b) an activity portion that exhibits site-directed enzymatic activity. The target cell can then be cultured under conditions in which the Cms1 polypeptide is expressed and cleaves the nucleotide sequence. It is noted that the system described herein does not require the addition of exogenous $Mg^{2+}$ or any other ions. Finally, prokaryotic cells comprising the modified nucleotide sequence can be selected. It is further noted that he prokaryotic cells comprising the modified nucleotide sequence or sequences are not the natural host cells of the polynucleotides encoding the Cms1 polypeptide of interest, and that a non-naturally occurring guide RNA is used to effect the desired changes in the prokaryotic nucleotide sequence or sequences. It is further noted that the targeted DNA may be present as part of the prokaryotic chromosome(s) or may be present on one or more plasmids or other non-chromosomal DNA molecules in the prokaryotic cell.

In some embodiments, the method can comprise introducing one Cms1 polypeptide (or encoding nucleic acid) and one guide RNA (or encoding DNA) into a prokaryotic cell wherein the Cms1 polypeptide introduces one double-stranded break in the target nucleotide sequence of the prokaryotic cellular DNA. In some embodiments, the method can comprise introducing one Cms1 polypeptide (or encoding nucleic acid) and at least one guide RNA (or encoding DNA) into a prokaryotic cell wherein the Cms1 polypeptide introduces more than one double-stranded break (i.e., two, three, or more than three double-stranded breaks) in the target nucleotide sequence of the prokaryotic cellular DNA. In embodiments in which an optional donor polynucleotide is not present, the double-stranded break in the nucleotide sequence can be repaired by a non-homologous end-joining (NHEJ) repair process. Because NHEJ is error-prone, deletions of at least one nucleotide, insertions of at least one nucleotide, substitutions of at least one nucleotide, or combinations thereof can occur during the repair of the break. Accordingly, the targeted nucleotide sequence can be modified or inactivated. For example, a single nucleotide change (SNP) can give rise to an altered protein product, or a shift in the reading frame of a coding sequence can inactivate or "knock out" the sequence such that no protein product is made. In embodiments in which the optional donor polynucleotide is present, the donor sequence in the donor polynucleotide can be exchanged with or integrated into the nucleotide sequence at the targeted site during repair of the double-stranded break. For example, in embodiments in which the donor sequence is flanked by upstream and downstream sequences having substantial sequence identity with upstream and downstream sequences, respectively, of the targeted site in the nucleotide sequence of the prokaryotic cell, the donor sequence can be exchanged with or integrated into the nucleotide sequence at the targeted site during repair mediated by homology-directed repair process. Alternatively, in embodiments in which the donor sequence is flanked by compatible overhangs (or the compatible overhangs are generated in situ by the Cms1 polypeptide) the donor sequence can be ligated directly with the cleaved nucleotide sequence by a non-homologous repair process during repair of the double-stranded break. Exchange or integration of the donor sequence into the nucleotide sequence modifies the targeted nucleotide sequence or introduces an exogenous sequence into the targeted nucleotide sequence of the prokaryotic cellular DNA.

In some embodiments, the double-stranded breaks caused by the action of the Cms1 nuclease or nucleases are repaired in such a way that DNA is deleted from the prokaryotic cellular DNA. In some embodiments one base, a few bases (i.e., 2, 3, 4, 5, 6, 7, 8, 9, or 10 bases), or a large section of DNA (i.e., more than 10, more than 50, more than 100, or more than 500 bases) is deleted from the prokaryotic cellular DNA.

In some embodiments, the expression of prokaryotic genes may be modulated as a result of the double-stranded breaks caused by the Cms1 nuclease or nucleases. In some embodiments, the expression of prokaryotic genes may be modulated by variant Cms1 nucleases comprising a mutation that renders the Cms1 nuclease incapable of producing a double-stranded break. In some preferred embodiments, the variant Cms1 nuclease comprising a mutation that renders the Cms1 nuclease incapable of producing a double-stranded break may be fused to a transcriptional activation or transcriptional repression domain.

The present invention may be used for transformation of any prokaryotic species, including, but not limited to, cyanobacteria, *Corynebacterium* sp., *Bifidobacterium* sp., *Mycobacterium* sp., *Streptomyces* sp., *Thermobifida* sp., *Chlamydia* sp., *Prochlorococcus* sp., *Synechococcus* sp., *Thermosynechococcus* sp., *Thermus* sp., *Bacillus* sp., *Clostridium* sp., *Geobacillus* sp., *Lactobacillus* sp., *Listeria* sp., *Staphylococcus* sp., *Streptococcus* sp., *Fusobacterium* sp., *Agrobacterium* sp., *Bradyrhizobium* sp., *Ehrlichia* sp., *Mesorhizobium* sp., *Nitrobacter* sp., *Rickettsia* sp., *Wolbachia* sp., *Zymomonas* sp., *Burkholderia* sp., *Neisseria* sp., *Ralstonia* sp., *Acinetobacter* sp., *Erwinia* sp., *Escherichia* sp., *Haemophilus* sp., *Legionella* sp., *Pasteurella* sp., *Pseudomonas* sp., *Psychrobacter* sp., *Salmonella* sp., *Shewanella* sp., *Shigella* sp., *Vibrio* sp., *Xanthomonas* sp., *Xylella* sp., *Yersinia* sp., *Campylobacter* sp., *Desulfovibrio* sp., *Helicobacter* sp., *Geobacter* sp., *Leptospira* sp., *Treponema* sp., *Mycoplasma* sp., and *Thermotoga* sp.

Methods for the introduction of nuclease proteins, DNA or RNA molecules encoding nuclease proteins, guide RNAs or DNA molecules encoding guide RNAs, and optional donor sequence DNA molecules into prokaryotic cells or organelles are known in the art, for instance in U.S. Patent Application 2016/0208243, herein incorporated by reference. Exemplary genetic modifications to prokaryotic cells that may be of particular value for industrial applications are also known in the art, for instance in U.S. Patent Application 2016/0208243, herein incorporated by reference.

D. Methods for Modifying a Nucleotide Sequence in a Viral Genome

Methods are provided herein for modifying a nucleotide sequence of a viral genome. The methods comprise introducing into a cell that comprises a virus of interest a DNA-targeting RNA or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cms1 polypeptide and also introducing to the target cell a Cms1 polypeptide, or a polynucleotide encoding a Cms1 polypeptide, wherein the Cms1 polypeptide comprises: (a) an RNA-binding portion that interacts with the DNA-targeting RNA; and (b) an activity portion that exhibits site-directed enzymatic activity. The target cell comprising the virus of interest can then be cultured under conditions in which the Cms1 polypeptide is expressed and cleaves the viral nucleotide sequence. Alternatively, the viral genome may be manipulated in vitro, wherein the guide polynucleotide, Cms1 polypeptide, and optional donor polynucleotide are incubated with a viral DNA sequence of interest outside of a cellular host.

V. Methods for Modulating Gene Expression

The methods disclosed herein further encompass modification of a nucleotide sequence or regulating expression of a nucleotide sequence in a genome host. The methods can comprise introducing into the genome host at least one fusion protein or nucleic acid encoding at least one fusion protein, wherein the fusion protein comprises a Cms1 polypeptide or a fragment or variant thereof and an effector domain, and (b) at least one guide RNA or DNA encoding the guide RNA, wherein the guide RNA guides the Cms1 polypeptide of the fusion protein to a target site in the targeted DNA and the effector domain of the fusion protein modifies the chromosomal sequence or regulates expression of one or more genes in near the targeted DNA sequence.

Fusion proteins comprising a Cms1 polypeptide or a fragment or variant thereof and an effector domain are described herein. In general, the fusion proteins disclosed herein can further comprise at least one nuclear localization signal, plastid signal peptide, mitochondrial signal peptide, or signal peptide capable of trafficking proteins to multiple subcellular locations. Nucleic acids encoding fusion proteins are described herein. In some embodiments, the fusion protein can be introduced into the genome host as an isolated protein (which can further comprise a cell-penetrating domain). Furthermore, the isolated fusion protein can be part of a protein-RNA complex comprising the guide RNA. In other embodiments, the fusion protein can be introduced into the genome host as a RNA molecule (which can be capped and/or polyadenylated). In still other embodiments, the fusion protein can be introduced into the genome host as a DNA molecule. For example, the fusion protein and the guide RNA can be introduced into the genome host as discrete DNA molecules or as part of the same DNA molecule. Such DNA molecules can be plasmid vectors.

In some embodiments, the method further comprises introducing into the genome host at least one donor polynucleotide as described elsewhere herein. Means for introducing molecules into genome hosts such as cells, as well as means for culturing cells (including cells comprising organelles) are described herein.

In certain embodiments in which the effector domain of the fusion protein is a cleavage domain, the method can comprise introducing into the genome host one fusion protein (or nucleic acid encoding one fusion protein) and two guide RNAs (or DNA encoding two guide RNAs). The two guide RNAs direct the fusion protein to two different target sites in the chromosomal sequence, wherein the fusion protein dimerizes (e.g., forms a homodimer) such that the two cleavage domains can introduce a double stranded break into the targeted DNA sequence. In embodiments in which the optional donor polynucleotide is not present, the double-stranded break in the targeted DNA sequence can be repaired by a non-homologous end-joining (NHEJ) repair process. Because NHEJ is error-prone, deletions of at least one nucleotide, insertions of at least one nucleotide, substitutions of at least one nucleotide, or combinations thereof can occur during the repair of the break. Accordingly, the targeted chromosomal sequence can be modified or inactivated. For example, a single nucleotide change (SNP) can give rise to an altered protein product, or a shift in the reading frame of a coding sequence can inactivate or "knock out" the sequence such that no protein product is made. In embodiments in which the optional donor polynucleotide is present, the donor sequence in the donor polynucleotide can be exchanged with or integrated into the targeted DNA sequence at the targeted site during repair of the double-stranded break. For example, in embodiments in which the donor sequence is flanked by upstream and downstream sequences having substantial sequence identity with upstream and downstream sequences, respectively, of the targeted site in the targeted DNA sequence, the donor sequence can be exchanged with or integrated into the targeted DNA sequence at the targeted site during repair mediated by homology-directed repair process. Alternatively, in embodiments in which the donor sequence is flanked by compatible overhangs (or the compatible overhangs are generated in situ by the Cms1 polypeptide) the donor sequence can be ligated directly with the cleaved targeted DNA sequence by a non-homologous repair process during repair of the double-stranded break. Exchange or integration of the donor sequence into the targeted DNA sequence modifies the targeted DNA sequence or introduces an exogenous sequence into the targeted DNA sequence.

In other embodiments in which the effector domain of the fusion protein is a cleavage domain, the method can comprise introducing into the genome host two different fusion proteins (or nucleic acid encoding two different fusion proteins) and two guide RNAs (or DNA encoding two guide RNAs). The fusion proteins can differ as detailed elsewhere herein. Each guide RNA directs a fusion protein to a specific target site in the targeted DNA sequence, wherein the fusion proteins can dimerize (e.g., form a heterodimer) such that the two cleavage domains can introduce a double stranded break into the targeted DNA sequence. In embodiments in which the optional donor polynucleotide is not present, the resultant double-stranded breaks can be repaired by a non-homologous repair process such that deletions of at least one nucleotide, insertions of at least one nucleotide, substitutions of at least one nucleotide, or combinations thereof can occur during the repair of the break. In embodiments in which the optional donor polynucleotide is present, the donor sequence in the donor polynucleotide can be exchanged with or integrated into the chromosomal sequence during repair of the double-stranded break by either a homology-based repair process (e.g., in embodiments in which the donor sequence is flanked by upstream and downstream sequences having substantial sequence identity with upstream and downstream sequences, respectively, of the targeted sites in the chromosomal sequence) or a non-homologous repair process (e.g., in embodiments in which the donor sequence is flanked by compatible overhangs).

In certain embodiments in which the effector domain of the fusion protein is a transcriptional activation domain or a transcriptional repressor domain, the method can comprise introducing into the genome host one fusion protein (or nucleic acid encoding one fusion protein) and one guide RNA (or DNA encoding one guide RNA). The guide RNA directs the fusion protein to a specific targeted DNA sequence, wherein the transcriptional activation domain or a transcriptional repressor domain activates or represses expression, respectively, of a gene or genes located near the targeted DNA sequence. That is, transcription may be affected for genes in close proximity to the targeted DNA sequence or may be affected for genes located at further distance from the targeted DNA sequence. It is well-known in the art that gene transcription can be regulated by distantly located sequences that may be located thousands of bases away from the transcription start site or even on a separate chromosome (Harmston and Lenhard (2013) *Nucleic Acids Res* 41:7185-7199).

In alternate embodiments in which the effector domain of the fusion protein is an epigenetic modification domain, the method can comprise introducing into the genome host one fusion protein (or nucleic acid encoding one fusion protein) and one guide RNA (or DNA encoding one guide RNA). The guide RNA directs the fusion protein to a specific targeted DNA sequence, wherein the epigenetic modification domain modifies the structure of the targeted DNA sequence. Epigenetic modifications include acetylation, methylation of histone proteins and/or nucleotide methylation. In some instances, structural modification of the chromosomal sequence leads to changes in expression of the chromosomal sequence.

VI. Organisms Comprising a Genetic Modification

A. Eukaryotes

Provided herein are eukaryotes, eukaryotic cells, organelles, and plant embryos comprising at least one nucleotide sequence that has been modified using a Cms1 polypeptide-mediated or fusion protein-mediated process as described herein. Also provided are eukaryotes, eukaryotic cells, organelles, and plant embryos comprising at least one DNA or RNA molecule encoding Cms1 polypeptide or fusion protein targeted to a chromosomal sequence of interest or a fusion protein, at least one guide RNA, and optionally one or more donor polynucleotide(s). The genetically modified eukaryotes disclosed herein can be heterozygous for the modified nucleotide sequence or homozygous for the modified nucleotide sequence. Eukaryotic cells comprising one or more genetic modifications in organellar DNA may be heteroplasmic or homoplasmic.

The modified chromosomal sequence of the eukaryotes, eukaryotic cells, organelles, and plant embryos may be modified such that it is inactivated, has up-regulated or down-regulated expression, or produces an altered protein product, or comprises an integrated sequence. The modified chromosomal sequence may be inactivated such that the sequence is not transcribed and/or a functional protein product is not produced. Thus, a genetically modified eukaryote comprising an inactivated chromosomal sequence may be termed a "knock out" or a "conditional knock out." The inactivated chromosomal sequence can include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). As a consequence of the mutation, the targeted chromosomal sequence is inactivated and a functional protein is not produced. The inactivated chromosomal sequence comprises no exogenously introduced sequence. Also included herein are genetically modified eukaryotes in which two, three, four, five, six, seven, eight, nine, or ten or more chromosomal sequences are inactivated.

The modified chromosomal sequence can also be altered such that it codes for a variant protein product. For example, a genetically modified eukaryote comprising a modified chromosomal sequence can comprise a targeted point mutation(s) or other modification such that an altered protein product is produced. In one embodiment, the chromosomal sequence can be modified such that at least one nucleotide is changed and the expressed protein comprises one changed amino acid residue (missense mutation). In another embodiment, the chromosomal sequence can be modified to comprise more than one missense mutation such that more than one amino acid is changed. Additionally, the chromosomal sequence can be modified to have a three nucleotide deletion or insertion such that the expressed protein comprises a single amino acid deletion or insertion. The altered or variant protein can have altered properties or activities compared to the wild type protein, such as altered substrate specificity, altered enzyme activity, altered kinetic rates, etc.

In some embodiments, the genetically modified eukaryote can comprise at least one chromosomally integrated nucleotide sequence. A genetically modified eukaryote comprising an integrated sequence may be termed a "knock in" or a "conditional knock in." The nucleotide sequence that is integrated sequence can, for example, encode an orthologous protein, an endogenous protein, or combinations of both. In one embodiment, a sequence encoding an orthologous protein or an endogenous protein can be integrated into a nuclear or organellar chromosomal sequence encoding a protein such that the chromosomal sequence is inactivated, but the exogenous sequence is expressed. In such a case, the sequence encoding the orthologous protein or endogenous protein may be operably linked to a promoter control sequence. Alternatively, a sequence encoding an orthologous protein or an endogenous protein may be integrated into a nuclear or organellar chromosomal sequence without affecting expression of a chromosomal sequence. For example, a sequence encoding a protein can be integrated into a "safe harbor" locus. The present disclosure also encompasses genetically modified eukaryotes in which two, three, four, five, six, seven, eight, nine, or ten or more sequences, including sequences encoding protein(s), are integrated into the genome. Any gene of interest as disclosed herein can be introduced integrated into the chromosomal sequence of the eukaryotic nucleus or organelle. In particular embodiments, genes that increase plant growth or yield are integrated into the chromosome.

The chromosomally integrated sequence encoding a protein can encode the wild type form of a protein of interest or can encode a protein comprising at least one modification such that an altered version of the protein is produced. For example, a chromosomally integrated sequence encoding a protein related to a disease or disorder can comprise at least one modification such that the altered version of the protein produced causes or potentiates the associated disorder. Alternatively, the chromosomally integrated sequence encoding a protein related to a disease or disorder can comprise at least one modification such that the altered version of the protein protects the eukaryote or eukaryotic cell against the development of the associated disease or disorder.

In certain embodiments, the genetically modified eukaryote can comprise at least one modified chromosomal sequence encoding a protein such that the expression pattern of the protein is altered. For example, regulatory regions controlling the expression of the protein, such as a promoter or a transcription factor binding site, can be altered such that the protein is over-expressed, or the tissue-specific or temporal expression of the protein is altered, or a combination thereof. Alternatively, the expression pattern of the protein can be altered using a conditional knockout system. A non-limiting example of a conditional knockout system includes a Cre-lox recombination system. A Cre-lox recombination system comprises a Cre recombinase enzyme, a site-specific DNA recombinase that can catalyze the recombination of a nucleic acid sequence between specific sites (lox sites) in a nucleic acid molecule. Methods of using this system to produce temporal and tissue specific expression are known in the art.

B. Prokaryotes

Provided herein are prokaryotes and prokaryotic cells comprising at least one nucleotide sequence that has been modified using a Cms1 polypeptide-mediated or fusion protein-mediated process as described herein. Also provided are prokaryotes and prokaryotic cells comprising at least one DNA or RNA molecule encoding Cms1 polypeptide or fusion protein targeted to a DNA sequence of interest or a fusion protein, at least one guide RNA, and optionally one or more donor polynucleotide(s).

The modified DNA sequence of the prokaryotes and prokaryotic cells may be modified such that it is inactivated, has up-regulated or down-regulated expression, or produces an altered protein product, or comprises an integrated sequence. The modified DNA sequence may be inactivated such that the sequence is not transcribed and/or a functional protein product is not produced. Thus, a genetically modified prokaryote comprising an inactivated chromosomal sequence may be termed a "knock out" or a "conditional knock out." The inactivated DNA sequence can include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). As a consequence of the mutation, the targeted DNA sequence is inactivated and a functional protein is not produced. The inactivated DNA sequence comprises no exogenously introduced sequence. Also included herein are genetically modified prokaryotes in which two, three, four, five, six, seven, eight, nine, or ten or more DNA sequences are inactivated.

The modified DNA sequence can also be altered such that it codes for a variant protein product. For example, a genetically modified prokaryote comprising a modified DNA sequence can comprise a targeted point mutation(s) or other modification such that an altered protein product is produced. In one embodiment, the DNA sequence can be modified such that at least one nucleotide is changed and the expressed protein comprises one changed amino acid residue (missense mutation). In another embodiment, the DNA sequence can be modified to comprise more than one missense mutation such that more than one amino acid is changed. Additionally, the DNA sequence can be modified to have a three nucleotide deletion or insertion such that the expressed protein comprises a single amino acid deletion or insertion. The altered or variant protein can have altered properties or activities compared to the wild type protein, such as altered substrate specificity, altered enzyme activity, altered kinetic rates, etc.

In some embodiments, the genetically modified prokaryote can comprise at least one integrated nucleotide sequence. A genetically modified prokaryote comprising an integrated sequence may be termed a "knock in" or a "conditional knock in." The nucleotide sequence that is integrated sequence can, for example, encode an orthologous protein, an endogenous protein, or combinations of both. In one embodiment, a sequence encoding an orthologous protein or an endogenous protein can be integrated into a prokaryotic DNA sequence encoding a protein such that the prokaryotic sequence is inactivated, but the exogenous sequence is expressed. In such a case, the sequence encoding the orthologous protein or endogenous protein may be operably linked to a promoter control sequence. Alternatively, a sequence encoding an orthologous protein or an endogenous protein may be integrated into a prokaryotic DNA sequence without affecting expression of a native prokaryotic sequence. For example, a sequence encoding a protein can be integrated into a "safe harbor" locus. The present disclosure also encompasses genetically modified prokaryotes in which two, three, four, five, six, seven, eight, nine, or ten or more sequences, including sequences encoding protein(s), are integrated into the prokaryotic genome or plasmids hosted by the prokaryote. Any gene of interest as disclosed herein can be introduced integrated into the DNA sequence of the prokaryotic chromosome, plasmid, or other extrachromosomal DNA.

The integrated sequence encoding a protein can encode the wild type form of a protein of interest or can encode a protein comprising at least one modification such that an altered version of the protein is produced. For example, an integrated sequence encoding a protein related to a disease or disorder can comprise at least one modification such that the altered version of the protein produced causes or potentiates the associated disorder. Alternatively, the integrated sequence encoding a protein related to a disease or disorder can comprise at least one modification such that the altered version of the protein reduces the infectivity of the prokaryote.

In certain embodiments, the genetically modified prokaryote can comprise at least one modified DNA sequence encoding a protein such that the expression pattern of the protein is altered. For example, regulatory regions controlling the expression of the protein, such as a promoter or a transcription factor binding site, can be altered such that the protein is over-expressed, or the temporal expression of the protein is altered, or a combination thereof. Alternatively, the expression pattern of the protein can be altered using a conditional knockout system. A non-limiting example of a conditional knockout system includes a Cre-lox recombination system. A Cre-lox recombination system comprises a Cre recombinase enzyme, a site-specific DNA recombinase that can catalyze the recombination of a nucleic acid sequence between specific sites (lox sites) in a nucleic acid molecule. Methods of using this system to produce temporal expression are known in the art.

C. Viruses

Provided herein are viruses and viral genomes comprising at least one nucleotide sequence that has been modified using a Cms1 polypeptide-mediated or fusion protein-mediated process as described herein. Also provided are viruses and viral genomes comprising at least one DNA or RNA molecule encoding Cms1 polypeptide or fusion protein targeted to a DNA sequence of interest or a fusion protein, at least one guide RNA, and optionally one or more donor polynucleotide(s).

The modified DNA sequence of the viruses and viral genomes may be modified such that it is inactivated, has up-regulated or down-regulated expression, or produces an altered protein product, or comprises an integrated sequence. The modified DNA sequence may be inactivated such that the sequence is not transcribed and/or a functional protein product is not produced. Thus, a genetically modified virus comprising an inactivated chromosomal sequence may be termed a "knock out" or a "conditional knock out." The inactivated DNA sequence can include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). As a consequence of the mutation, the targeted DNA sequence is inactivated and a functional protein is not produced. The inactivated DNA sequence comprises no exogenously introduced sequence. Also included herein are genetically modified viruses in which two, three, four, five, six, seven, eight, nine, or ten or more viral sequences are inactivated.

The modified DNA sequence can also be altered such that it codes for a variant protein product. For example, a genetically modified virus comprising a modified DNA sequence can comprise a targeted point mutation(s) or other modification such that an altered protein product is produced. In one embodiment, the DNA sequence can be modified such that at least one nucleotide is changed and the expressed protein comprises one changed amino acid residue (missense mutation). In another embodiment, the DNA sequence can be modified to comprise more than one missense mutation such that more than one amino acid is changed. Additionally, the DNA sequence can be modified to have a three nucleotide deletion or insertion such that the expressed protein comprises a single amino acid deletion or insertion. The altered or variant protein can have altered properties or activities compared to the wild type protein, such as altered substrate specificity, altered enzyme activity, altered kinetic rates, etc.

In some embodiments, the genetically modified virus can comprise at least one integrated nucleotide sequence. A genetically modified virus comprising an integrated sequence may be termed a "knock in" or a "conditional knock in." The nucleotide sequence that is integrated sequence can, for example, encode an orthologous protein, an endogenous protein, or combinations of both. In one embodiment, a sequence encoding an orthologous protein or an endogenous protein can be integrated into a viral DNA sequence encoding a protein such that the viral sequence is inactivated, but the exogenous sequence is expressed. In such a case, the sequence encoding the orthologous protein or endogenous protein may be operably linked to a promoter control sequence. Alternatively, a sequence encoding an orthologous protein or an endogenous protein may be integrated into a viral DNA sequence without affecting expression of a native viral sequence. For example, a sequence encoding a protein can be integrated into a "safe harbor" locus. The present disclosure also encompasses genetically modified viruses in which two, three, four, five, six, seven, eight, nine, or ten or more sequences, including sequences encoding protein(s), are integrated into the viral genome. Any gene of interest as disclosed herein can be introduced integrated into the DNA sequence of the viral genome.

The integrated sequence encoding a protein can encode the wild type form of a protein of interest or can encode a protein comprising at least one modification such that an altered version of the protein is produced. For example, an integrated sequence encoding a protein related to a disease or disorder can comprise at least one modification such that the altered version of the protein produced causes or potentiates the associated disorder. Alternatively, the integrated sequence encoding a protein related to a disease or disorder can comprise at least one modification such that the altered version of the protein reduces the infectivity of the virus. In certain embodiments, the genetically modified virus can comprise at least one modified DNA sequence encoding a protein such that the expression pattern of the protein is altered. For example, regulatory regions controlling the expression of the protein, such as a promoter or a transcription factor binding site, can be altered such that the protein is over-expressed, or the temporal expression of the protein is altered, or a combination thereof. Alternatively, the expression pattern of the protein can be altered using a conditional knockout system. A non-limiting example of a conditional knockout system includes a Cre-lox recombination system. A Cre-lox recombination system comprises a Cre recombinase enzyme, a site-specific DNA recombinase that can catalyze the recombination of a nucleic acid sequence between specific sites (lox sites) in a nucleic acid molecule. Methods of using this system to produce temporal expression are known in the art.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

Embodiments of the Invention Include:

1. A method of modifying a nucleotide sequence at a target site in the genome of a eukaryotic cell comprising:
   introducing into said eukaryotic cell
   (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cms1 polypeptide; and
   (ii) a Cms1 polypeptide, or a polynucleotide encoding a Cms1 polypeptide, wherein the Cms1 polypeptide comprises: (a) an RNA-binding portion that interacts with the DNA-targeting RNA; and (b) an activity portion that exhibits site-directed enzymatic activity.

2. A method of modifying a nucleotide sequence at a target site in the genome of a prokaryotic cell comprising:
   introducing into said prokaryotic cell
   (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cms1 polypeptide; and
   (ii) a Cms1 polypeptide, or a polynucleotide encoding a Cms1 polypeptide, wherein the Cms1 polypeptide comprises: (a) an RNA-binding portion that interacts with the DNA-targeting RNA; and (b) an activity portion that exhibits site-directed enzymatic activity,
   wherein said prokaryotic cell is not the native host of a gene encoding said Cms1 polypeptide.

3. A method of modifying a nucleotide sequence at a target site in the genome of a plant cell comprising:
   introducing into said plant cell
   (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cms1 polypeptide; and
   (ii) a Cms1 polypeptide, or a polynucleotide encoding a Cms1 polypeptide, wherein the Cms1 polypeptide comprises: (a) an RNA-binding portion that interacts with the DNA-targeting RNA; and (b) an activity portion that exhibits site-directed enzymatic activity.

4. The method of embodiment 3, further comprising:
   culturing the plant under conditions in which the Cms1 polypeptide is expressed and cleaves the nucleotide sequence at the target site to produce a modified nucleotide sequence; and
   selecting a plant comprising said modified nucleotide sequence.

5. The method of any one of embodiments 1-4, wherein cleaving of the nucleotide sequence at the target site comprises a double strand break at or near the sequence to which the DNA-targeting RNA sequence is targeted.

6. The method of embodiment 5, wherein said double strand break is a staggered double strand break.

7. The method of embodiment 6, wherein said staggered double strand break creates a 5' overhang of 3-6 nucleotides.

8. The method of any one of embodiments 1-7, wherein said DNA-targeting RNA is a guide RNA (gRNA).

9. The method of any one of embodiments 1-8, wherein said modified nucleotide sequence comprises insertion of heterologous DNA into the genome of the cell, deletion of a nucleotide sequence from the genome of the cell, or mutation of at least one nucleotide in the genome of the cell.

10. The method of any one of embodiments 1-9, wherein said Cms1 polypeptide is selected from the group consisting of: SEQ ID NOs:20-23, 30-69, 208-211, and 222-254.

11. The method of any one of embodiments 1-10, wherein said polynucleotide encoding a Cms1 polypeptide is selected from the group consisting of SEQ ID NOs:16-19, 24-27, 70-146, 174-176, 212-215, and 255-287.

12. The method of any one of embodiments 1-11, wherein said Cms1 polypeptide has at least 80% identity with one or more polypeptide sequences selected from the group consisting of SEQ ID NOs: 20-23, 30-69, 208-211, and 222-254.

13. The method of any one of embodiments 1-12, wherein said polynucleotide encoding a Cms1 polypeptide has at least 70% identity with one or more nucleic acid sequences selected from the group consisting of SEQ ID NOs: 16-19, 24-27, 70-146, 174-176, 212-215, and 255-287.

14. The method of any one of embodiments 1-13, wherein the Cms1 polypeptide forms a homodimer or heterodimer.

15. The method of embodiment 3, wherein said plant cell is from a monocotyledonous species.

16. The method of embodiment 3, wherein said plant cell is from a dicotyledonous species.

17. The method of any one of embodiments 1-16, wherein the expression of the Cms1 polypeptide is under the control of an inducible or constitutive promoter.

18. The method of any one of embodiments 1-17, wherein the expression of the Cms1 polypeptide is under the control of a cell type-specific or developmentally-preferred promoter.

19. The method of any one of embodiments 1-18, wherein the PAM sequence comprises 5'-TTN, wherein N can be any nucleotide.

20. The method of embodiment 3, wherein said nucleotide sequence at a target site in the genome of a plant cell encodes an SBPase, FBPase, FBP aldolase, AGPase large subunit, AGPase small subunit, sucrose phosphate synthase, starch synthase, PEP carboxylase, pyruvate phosphate dikinase, transketolase, rubisco small subunit, or rubisco activase protein, or encodes a transcription factor that regulates the expression of one or more genes encoding an SBPase, FBPase, FBP aldolase, AGPase large subunit, AGPase small subunit, sucrose phosphate synthase, starch synthase, PEP carboxylase, pyruvate phosphate dikinase, transketolase, rubisco small subunit, or rubisco activase protein.

21. The method of any one of embodiments 1-20, the method further comprising contacting the target site with a donor polynucleotide, wherein the donor polynucleotide, a portion of the donor polynucleotide, a copy of the donor polynucleotide, or a portion of a copy of the donor polynucleotide integrates into the target DNA.

22. The method of any one of embodiments 1-21, wherein the target DNA is modified such that nucleotides within the target DNA are deleted.

23. The method of any one of embodiments 1-22, wherein said polynucleotide encoding a Cms1 polypeptide is codon optimized for expression in a plant cell.

24. The method of any one of embodiments 1-23, wherein the expression of said nucleotide sequence is increased or decreased.

25. The method of any one of embodiments 1-24, wherein the polynucleotide encoding a Cms1 polypeptide is operably linked to a promoter that is constitutive, cell specific, inducible, or activated by alternative splicing of a suicide exon.

26. The method of any one of embodiments 1-25, wherein said Cms1 polypeptide comprises one or more mutations that reduce or eliminate the nuclease activity of said Cms1 polypeptide.

27. The method of embodiment 26, wherein said mutated Cms1 polypeptide comprises a mutation in a position corresponding to positions 701 or 922 of SmCms1 (SEQ ID NO:10) or to positions 848 or 1213 of SulfCms1 (SEQ ID NO:11) when aligned for maximum identity.

28. The method of embodiment 27, wherein said mutations in positions corresponding to positions 701 or 922 of SmCms1 (SEQ ID NO:10) are D701A and E922A, respectively, or wherein said mutations in positions corresponding to positions 848 and 1213 of SulfCms1 (SEQ ID NO:11) are D848A and D1213A, respectively.

29. The method of any one of embodiments 26-28, wherein the mutated Cms1 polypeptide is fused to a transcriptional activation domain.

30. The method of embodiment 29, wherein the mutated Cms1 polypeptide is directly fused to a transcriptional activation domain or fused to a transcriptional activation domain with a linker.

31. The method of any one of embodiments 26-28, wherein the mutated Cms1 polypeptide is fused to a transcriptional repressor domain.

32. The method of embodiment 31, wherein the mutated Cms1 polypeptide is fused to a transcriptional repressor domain with a linker.

33. The method of any one of embodiments 1-32 wherein said Cms1 polypeptide further comprises a nuclear localization signal.

34. The method of embodiment 33 wherein said nuclear localization signal comprises SEQ ID NO:1, or is encoded by SEQ ID NO:2.

35. The method of any one of embodiments 1-32 wherein said Cms1 polypeptide further comprises a chloroplast signal peptide.

36. The method of any one of embodiments 1-32 wherein said Cms1 polypeptide further comprises a mitochondrial signal peptide.

37. The method of any one of embodiments 1-32 wherein said Cms1 polypeptide further comprises a signal peptide that targets said Cms1 polypeptide to multiple subcellular locations.

38. A nucleic acid molecule comprising a polynucleotide sequence encoding a Cms1 polypeptide, wherein said polynucleotide sequence has been codon optimized for expression in a plant cell.

39. A nucleic acid molecule comprising a polynucleotide sequence encoding a Cms1 polypeptide, wherein said polynucleotide sequence has been codon optimized for expression in a eukaryotic cell.

40. A nucleic acid molecule comprising a polynucleotide sequence encoding a Cms1 polypeptide, wherein said polynucleotide sequence has been codon optimized for expression in a prokaryotic cell, wherein said prokaryotic cell is not the natural host of said Cms1 polypeptide.

41. The nucleic acid molecule of any one of embodiments 38-40, wherein said polynucleotide sequence is selected from the group consisting of: SEQ ID NOs: 16-19, 24-27, 70-146, 174-176, 212-215, and 255-287, or a fragment or variant thereof, or wherein said polynucleotide sequence encodes a Cms1 polypeptide selected from the group consisting of SEQ ID NOs: 20-23, 30-69, 208-211, and 222-254, and wherein said polynucleotide sequence encoding a Cms1 polypeptide is operably linked to a promoter that is heterologous to the polynucleotide sequence encoding a Cms1 polypeptide.

42. The nucleic acid molecule of any one of embodiments 38-40, wherein said variant polynucleotide sequence has at least 70% sequence identity to a polynucleotide sequence selected from the group consisting of: SEQ ID NOs: 16-19, 24-27, 70-146, 174-176, 212-215, and 255-287, or wherein said polynucleotide sequence encodes a Cms1 polypeptide that has at least 80% sequence identity to a polypeptide selected from the group consisting of SEQ ID NOs: 20-23, 30-69, 208-211, and 222-254, and wherein said polynucleotide sequence encoding a Cms1 polypeptide is operably linked to a promoter that is heterologous to the polynucleotide sequence encoding a Cms1 polypeptide.

43. The nucleic acid molecule of any one of embodiments 38-40, wherein said Cms1 polypeptide comprises an amino acid sequence selected from the group consisting of: SEQ ID NOs: 20-23, 30-69, 208-211, and 222-254, or a fragment or variant thereof.

44. The nucleic acid molecule of embodiment 43, wherein said variant polypeptide sequence has at least 70% sequence identity to a polypeptide sequence selected from the group consisting of: SEQ ID NOs: 20-23, 30-69, 208-211, and 222-254.

45. The nucleic acid molecule of any one of embodiments 38-44, wherein said polynucleotide sequence encoding a Cms1 polypeptide is operably linked to a promoter that is active in a plant cell.

46. The nucleic acid molecule of any one of embodiments 38-44, wherein said polynucleotide sequence encoding a Cms1 polypeptide is operably linked to a promoter that is active in a eukaryotic cell.

47. The nucleic acid molecule of any one of embodiments 38-44, wherein said polynucleotide sequence encoding a Cms1 polypeptide is operably linked to a promoter that is active in a prokaryotic cell.

48. The nucleic acid molecule of any one of embodiments 38-44, wherein said polynucleotide sequence encoding a Cms1 polypeptide is operably linked to a constitutive promoter, inducible promoter, cell type-specific promoter, or developmentally-preferred promoter.
49. The nucleic acid molecule of any one of embodiments 38-44, wherein said nucleic acid molecule encodes a fusion protein comprising said Cms1 polypeptide and an effector domain.
50. The nucleic acid molecule of embodiment 49, wherein said effector domain is selected from the group consisting of: transcriptional activator, transcriptional repressor, nuclear localization signal, and cell penetrating signal.
51. The nucleic acid molecule of embodiment 50, wherein said Cms1 polypeptide is mutated to reduce or eliminate nuclease activity.
52. The nucleic acid molecule of embodiment 51, wherein said mutated Cms1 polypeptide comprises a mutation in a position corresponding to positions 701 or 922 of SmCms1 (SEQ ID NO:10) or to positions 848 and 1213 of SulfCms1 (SEQ ID NO:11) when aligned for maximum identity.
53. The nucleic acid molecule of any one of embodiments 49-52, wherein said Cms1 polypeptide is fused to said effector domain with a linker.
54. The nucleic acid molecule of any one of embodiments 38-53, wherein said Cms1 polypeptide forms a dimer.
55. A fusion protein encoded by the nucleic acid molecule of any one of embodiments 49-54.
56. A Cms1 polypeptide encoded by the nucleic acid molecule of any one of embodiments 38-44.
57. A Cms1 polypeptide mutated to reduce or eliminate nuclease activity.
58. The Cms1 polypeptide of embodiment 57, wherein said mutated Cms1 polypeptide comprises a mutation in a position corresponding to positions 701 or 922 of SmCms1 (SEQ ID NO:10) or to positions 848 and 1213 of SulfCms1 (SEQ ID NO:11) when aligned for maximum identity.
59. A plant cell, eukaryotic cell, or prokaryotic cell comprising the nucleic acid molecule of any one of embodiments 38-54.
60. A plant cell, eukaryotic cell, or prokaryotic cell comprising the fusion protein or polypeptide of any one of embodiments 55-58.
61. A plant cell produced by the method of any one of embodiments 1 and 3-37.
62. A plant comprising the nucleic acid molecule of any one of embodiments 38-54.
63. A plant comprising the fusion protein or polypeptide of any one of embodiments 55-58.
64. A plant produced by the method of any one of embodiments 1 and 3-37.
65. The seed of the plant of any one of embodiments 62-64.
66. The method of any one of embodiments 1 and 3-37 wherein said modified nucleotide sequence comprises insertion of a polynucleotide that encodes a protein conferring antibiotic or herbicide tolerance to transformed cells.
67. The method of embodiment 66 wherein said polynucleotide that encodes a protein conferring antibiotic or herbicide tolerance comprises SEQ ID NO:7, or encodes a protein that comprises SEQ ID NO:8.
68. The method of any one of embodiments 3-37 wherein said target site in the genome of a plant cell comprises SEQ ID NO:12, or shares at least 80% identity with a portion or fragment of SEQ ID NO:12.
69. The method of any one of embodiments 1-37 wherein said DNA polynucleotide encoding a DNA-targeting RNA comprises SEQ ID NO:15.
70. The nucleic acid molecule of any one of embodiments 38-54 wherein said polynucleotide sequence encoding a Cms1 polypeptide further comprises a polynucleotide sequence encoding a nuclear localization signal.
71. The nucleic acid molecule of embodiment 70 wherein said nuclear localization signal comprises SEQ ID NO:1 or is encoded by SEQ ID NO:2.
72. The nucleic acid molecule of any one of embodiments 38-54 wherein said polynucleotide sequence encoding a Cms1 polypeptide further comprises a polynucleotide sequence encoding a chloroplast signal peptide.
73. The nucleic acid molecule of any one of embodiments 38-54 wherein said polynucleotide sequence encoding a Cms1 polypeptide further comprises a polynucleotide sequence encoding a mitochondrial signal peptide.
74. The nucleic acid molecule of any one of embodiments 38-54 wherein said polynucleotide sequence encoding a Cms1 polypeptide further comprises a polynucleotide sequence encoding a signal peptide that targets said Cms1 polypeptide to multiple subcellular locations.
75. The fusion protein of embodiment 55 wherein said fusion protein further comprises a nuclear localization signal, chloroplast signal peptide, mitochondrial signal peptide, or signal peptide that targets said Cms1 polypeptide to multiple subcellular locations.
76. The Cms1 polypeptide of any one of embodiments 56-58 wherein said Cms1 polypeptide further comprises a nuclear localization signal, chloroplast signal peptide, mitochondrial signal peptide, or signal peptide that targets said Cms1 polypeptide to multiple subcellular locations.
77. The method of any one of embodiments 1-37 wherein said Cms1 polypeptide comprises one or more sequence motifs selected from the group consisting of SEQ ID NOs:177-186.
78. The method of any one of embodiments 1-37 wherein said Cms1 polypeptide comprises one or more sequence motifs selected from the group consisting of SEQ ID NOs:288-289 and 187-201.
79. The method of any one of embodiments 1-37 wherein said Cms1 polypeptide comprises one or more sequence motifs selected from the group consisting of SEQ ID NOs:290-296.
80. The nucleic acid molecule of any one of embodiments 38-54 wherein said Cms1 polypeptide comprises one or more sequence motifs selected from the group consisting of SEQ ID NOs: 177-186.
81. The nucleic acid molecule of any one of embodiments 38-54 wherein said Cms1 polypeptide comprises one or more sequence motifs selected from the group consisting of SEQ ID NOs:288-289 and 187-201.
82. The nucleic acid molecule of any one of embodiments 38-54 wherein said Cms1 polypeptide comprises one or more sequence motifs selected from the group consisting of SEQ ID NOs: 290-296.

The following examples are offered by way of illustration and not by way of limitation.

EXPERIMENTAL

Example 1

Cloning Plant Transformation Constructs

Cms1-containing constructs are summarized in Table 1. Briefly, the Cms1 genes were plant codon optimized, de novo synthesized by GenScript (Piscataway, N.J.) and amplified by PCR to add an N-terminal SV40 nuclear localization tag (SEQ ID NO: 2) in frame with the Cms1 coding sequence of interest as well as restriction enzyme sites for cloning. Using the appropriate restriction enzyme sites, each individual Cms1 gene was cloned downstream of the 2×35s promoter (SEQ ID NO:3). It is noted that SEQ ID NO:16, encoding the ADurb.160Cms1 protein (SEQ ID NO:20), was derived from an organism that appears to use TGA codons to encode glycine rather than a stop codon as in the universal genetic code used by most organisms. Hence, the native gene encoding the ADurb.160Cms1 protein (SEQ ID NO:24) includes what appear to be multiple premature stop codons; analysis of this gene with TGA encoding glycine, however, uncovers a full-length open reading frame. Similarly, SEQ ID NOs:82, 91, 92, 100, 105, 213, 255, 259, 266, 267, 268, 270, 271, 272, 273, 275, 276, 277, 279, 280, 284, 285, and 286 also appear to use a non-universal genetic code, with TGA codons encoding glycine.

Plasmids encoding guide RNAs targeted to a region of the rice (*Oryza sativa* cv. Kitaake) CAO1 gene (SEQ ID NO:12) were synthesized with the guide RNA flanked by the rice U6 (OsU6) promoter (SEQ ID NO:5) at its 5' end and the OsU6 terminator (SEQ ID NO:6) at its 3' end. The guide RNA had the sequence of SEQ ID NO:15. Guide RNA plasmids are summarized in Table 2.

Plasmid 131632, containing repair donor cassette (SEQ ID NO:13), was designed with approximately 1,000-base pair homology upstream and downstream of the targeted site within the OsCAO1 gene. The repair donor cassette included the maize ubiquitin promoter (SEQ ID NO:9) operably linked to a hygromycin resistance gene (SEQ ID NO:7, encoding SEQ ID NO:8), which was flanked at its 3' end by the Cauliflower Mosaic Virus 35S polyA sequence (SEQ ID NO:4). Plasmid 131592 was designed similarly to plasmid 131632, but without any homology arms up- or downstream of the hygromycin cassette. As such, plasmid 131592 contains nucleotides 1,001-4,302 from SEQ ID NO:13, including the maize ubiquitin promoter (SEQ ID NO:9) operably linked to a hygromycin resistance gene (SEQ ID NO:7, encoding SEQ ID NO:8), flanked at its 3' end by the Cauliflower Mosaic Virus 35S polyA sequence (SEQ ID NO:4).

TABLE 1

Cms1 vectors

| Construct Number | Promoter | Cms1 gene[1] | Terminator |
|---|---|---|---|
| 132363 | 2X 35S (SEQ ID NO: 3) | ADurb.160Cms1 (SEQ ID NO:16, encoding SEQ ID NO: 20) | 35S poly A (SEQ ID NO: 4) |
| 132388 | 2X 35S (SEQ ID NO: 3) | AuxCms1 (SEQ ID NO: 17, encoding SEQ ID NO: 21) | 35S poly A (SEQ ID NO: 4) |
| 132389 | 2X 35S (SEQ ID NO: 3) | LAHSCms1 (SEQ ID NO: 18, encoding SEQ ID NO: 22) | 35S poly A (SEQ ID NO: 4) |
| 132390 | 2X 35S (SEQ ID NO: 3) | Sm82Cms1 (SEQ ID NO: 19, encoding SEQ ID NO: 23) | 35S poly A (SEQ ID NO: 4) |
| 132437 | 2X 35S (SEQ ID NO: 3) | Unk1Cms1 (SEQ ID NO: 110, encoding SEQ ID NO: 30) | 35S poly A (SEQ ID NO: 4) |
| 132438 | 2X 35S (SEQ ID NO: 3) | Unk2Cms1 (SEQ ID NO: 111, encoding SEQ ID NO: 31) | 35S poly A (SEQ ID NO: 4) |
| 132439 | 2X 35S (SEQ ID NO: 3) | Unk3Cms1 (SEQ ID NO: 112, encoding SEQ ID NO: 32) | 35S poly A (SEQ ID NO: 4) |
| 132455 | 2X 35S (SEQ ID NO: 3) | Unk4Cms1 (SEQ ID NO: 113, encoding SEQ ID NO: 33) | 35S poly A (SEQ ID NO: 4) |
| 132463 | 2X 35S (SEQ ID NO: 3) | Unk5Cms1 (SEQ ID NO: 114, encoding SEQ ID NO: 34) | 35S poly A (SEQ ID NO: 4) |
| 132470 | 2X 35S (SEQ ID NO: 3) | Unk6Cms1 (SEQ ID NO: 115, encoding SEQ ID NO: 35) | 35S poly A (SEQ ID NO: 4) |
| 132456 | 2X 35S (SEQ ID NO: 3) | Unk7Cms1 (SEQ ID NO: 116, encoding SEQ ID NO: 36) | 35S poly A (SEQ ID NO: 4) |
| 132464 | 2X 35S (SEQ ID NO: 3) | Unk8Cms1 (SEQ ID NO: 117, encoding SEQ ID NO: 37) | 35S poly A (SEQ ID NO: 4) |
| 132465 | 2X 35S (SEQ ID NO: 3) | Unk9Cms1 (SEQ ID NO: 118, encoding SEQ ID NO: 38) | 35S poly A (SEQ ID NO: 4) |
| 132457 | 2X 35S (SEQ ID NO: 3) | Unk10Cms1 (SEQ ID NO: 119, encoding SEQ ID NO: 39) | 35S poly A (SEQ ID NO: 4) |
| 132466 | 2X 35S (SEQ ID NO: 3) | Unk11Cms1 (SEQ ID NO: 120, encoding SEQ ID NO: 40) | 35S poly A (SEQ ID NO: 4) |
| 132502 | 2X 35S (SEQ ID NO: 3) | Unk4Cms1 (SEQ ID NO: 221, encoding SEQ ID NO: 33) | 35S poly A (SEQ ID NO: 4) |
| 132504 | 2X 35S (SEQ ID NO: 3) | Unk14Cms1 (SEQ ID NO: 122, encoding SEQ ID NO: 42) | 35S poly A (SEQ ID NO: 4) |
| 132505 | 2X 35S (SEQ ID NO: 3) | Unk15Cms1 (SEQ ID NO: 123, encoding SEQ ID NO: 43) | 35S poly A (SEQ ID NO: 4) |
| 132506 | 2X 35S (SEQ ID NO: 3) | Unk16Cms1 (SEQ ID NO: 124, encoding SEQ ID NO: 44) | 35S poly A (SEQ ID NO: 4) |
| 132507 | 2X 35S (SEQ ID NO: 3) | Unk17Cms1 (SEQ ID NO: 125, encoding SEQ ID NO: 45) | 35S poly A (SEQ ID NO: 4) |
| 132508 | 2X 35S (SEQ ID NO: 3) | Unk18Cms1 (SEQ ID NO: 126, encoding SEQ ID NO: 46) | 35S poly A (SEQ ID NO: 4) |
| 132509 | 2X 35S (SEQ ID NO: 3) | Unk19Cms1 (SEQ ID NO: 127, encoding SEQ ID NO: 47) | 35S poly A (SEQ ID NO: 4) |
| 132510 | 2X 35S (SEQ ID NO: 3) | Unk20Cms1 (SEQ ID NO: 128, encoding SEQ ID NO: 48) | 35S poly A (SEQ ID NO: 4) |
| 132511 | 2X 35S (SEQ ID NO: 3) | Unk21Cms1 (SEQ ID NO: 129, encoding SEQ ID NO: 49) | 35S poly A (SEQ ID NO: 4) |
| 132512 | 2X 35S (SEQ ID NO: 3) | Unk22Cms1 (SEQ ID NO: 130, encoding SEQ ID NO: 50) | 35S poly A (SEQ ID NO: 4) |
| 132513 | 2X 35S (SEQ ID NO: 3) | Unk23Cms1 (SEQ ID NO: 131, encoding SEQ ID NO: 51) | 35S poly A (SEQ ID NO: 4) |
| 132514 | 2X 35S (SEQ ID NO: 3) | Unk24Cms1 (SEQ ID NO: 132, encoding SEQ ID NO: 52) | 35S poly A (SEQ ID NO: 4) |
| 132515 | 2X 35S (SEQ ID NO: 3) | Unk25Cms1 (SEQ ID NO: 133, encoding SEQ ID NO: 53) | 35S poly A (SEQ ID NO: 4) |
| 132516 | 2X 35S (SEQ ID NO: 3) | Unk26Cms1 (SEQ ID NO: 134, encoding SEQ ID NO: 54) | 35S poly A (SEQ ID NO: 4) |
| 132517 | 2X 35S (SEQ ID NO: 3) | Unk27Cms1 (SEQ ID NO: 135, encoding SEQ ID NO: 55) | 35S poly A (SEQ ID NO: 4) |
| 132518 | 2X 35S (SEQ ID NO: 3) | Unk28Cms1 (SEQ ID NO: 136, encoding SEQ ID NO: 56) | 35S poly A (SEQ ID NO: 4) |
| 132519 | 2X 35S (SEQ ID NO: 3) | Unk29Cms1 (SEQ ID NO: 137, encoding SEQ ID NO: 57) | 35S poly A (SEQ ID NO: 4) |
| 132520 | 2X 35S (SEQ ID NO: 3) | Unk30Cms1 (SEQ ID NO: 138, encoding SEQ ID NO: 58) | 35S poly A (SEQ ID NO: 4) |
| 132521 | 2X 35S (SEQ ID NO: 3) | Unk31Cms1 (SEQ ID NO: 139, encoding SEQ ID NO: 59) | 35S poly A (SEQ ID NO: 4) |
| 132522 | 2X 35S (SEQ ID NO: 3) | Unk32Cms1 (SEQ ID NO: 140, encoding SEQ ID NO: 60) | 35S poly A (SEQ ID NO: 4) |
| 132523 | 2X 35S (SEQ ID NO: 3) | Unk33Cms1 (SEQ ID NO: 141, encoding SEQ ID NO: 61) | 35S poly A (SEQ ID NO: 4) |
| 132524 | 2X 35S (SEQ ID NO: 3) | Unk34Cms1 (SEQ ID NO: 142, encoding SEQ ID NO: 62) | 35S poly A (SEQ ID NO: 4) |
| 132525 | 2X 35S (SEQ ID NO: 3) | Unk35Cms1 (SEQ ID NO: 143, encoding SEQ ID NO: 63) | 35S poly A (SEQ ID NO: 4) |
| 132526 | 2X 35S (SEQ ID NO: 3) | Unk36Cms1 (SEQ ID NO: 144, encoding SEQ ID NO: 64) | 35S poly A (SEQ ID NO: 4) |
| 132527 | 2X 35S (SEQ ID NO: 3) | Unk37Cms1 (SEQ ID NO: 145, encoding SEQ ID NO: 65) | 35S poly A (SEQ ID NO: 4) |
| 132528 | 2X 35S (SEQ ID NO: 3) | Unk38Cms1 (SEQ ID NO: 146, encoding SEQ ID NO: 66) | 35S poly A (SEQ ID NO: 4) |
| 132529 | 2X 35S (SEQ ID NO: 3) | Unk39Cms1 (SEQ ID NO: 174, encoding SEQ ID NO: 67) | 35S poly A (SEQ ID NO: 4) |
| 132530 | 2X 35S (SEQ ID NO: 3) | Unk40Cms1 (SEQ ID NO: 175, encoding SEQ ID NO: 68) | 35S poly A (SEQ ID NO: 4) |
| 132531 | 2X 35S (SEQ ID NO: 3) | Unk41Cms1 (SEQ ID NO: 176, encoding SEQ ID NO: 69) | 35S poly A (SEQ ID NO: 4) |

[1]Each Cms1 gene was fused in-frame with the SV40 nuclear localization signal (SEQ ID NO: 2, encoding the amino acid sequence of SEQ ID NO: 1) at its 5' end.

TABLE 2

Guide RNA vectors

| Construct Number | Promoter | gRNA sequence | Terminator |
|---|---|---|---|
| 131608 | OsU6 (SEQ ID NO: 5) | AATTTCTACTGTTGTAGATTGGAGCAACACCTGAAG GAAGGCT (SEQ ID NO: 15) | OsU6 (SEQ ID NO: 6) |

Example 2

Rice Transformation

For introduction of the Cms1 cassette, gRNA-containing plasmid, and repair donor cassette into rice cells, particle bombardment was used. For bombardment, 2 mg of 0.6 μm gold particles were weighed out and transferred to sterile 1.5-mL tubes. 500 mL of 100% ethanol was added, and the tubes were sonicated for 10-15 seconds. Following centrifugation, the ethanol was removed. One milliliter of sterile, double-distilled water was then added to the tube containing the gold beads. The bead pellet was briefly vortexed and then was re-formed by centrifugation, after which the water was removed from the tube. In a sterile laminar flow hood, DNA was coated onto the beads. Table 3 shows the amounts of DNA added to the beads. The plasmid containing the Cms1 cassette, the gRNA-containing plasmid, and the repair donor cassette were added to the beads and sterile, double-distilled water was added to bring the total volume to 50 μL. To this, 20 μL of spermidine (1 M) was added, followed by 50 μL of CaCl$_2$ (2.5 M). The gold particles were allowed to pellet by gravity for several minutes, and were then pelleted by centrifugation. The supernatant liquid was removed, and 800 μL of 100% ethanol was added. Following a brief sonication, the gold particles were allowed to pellet by gravity for 3-5 minutes, then the tube was centrifuged to form a pellet. The supernatant was removed and 30 μL of 100% ethanol was added to the tube. The DNA-coated gold particles were resuspended in this ethanol by vortexing, and 10 μL of the resuspended gold particles were added to each of three macro-carriers (Bio-Rad, Hercules, Calif.). The macro-carriers were allowed to air-dry for 5-10 minutes in the laminar flow hood to allow the ethanol to evaporate.

TABLE 3

Amounts of DNA used for particle bombardment experiments (all amounts are per 2 mg of gold particles)

| | |
|---|---|
| Cms1 plasmid | 1.5 μg |
| gRNA-containing plasmid | 1.5 μg |
| Repair donor cassette plasmid | 3-15 μg |
| Sterile, double-distilled water | Add to bring total volume to 50 μL |

Rice callus tissue was used for bombardment. The rice callus was maintained on callus induction medium (CIM; 3.99 g/L N6 salts and vitamins, 0.3 g/L casein hydrolysates, 30 g/L sucrose, 2.8 g/L L-proline, 2 mg/L 2,4-D, 8 g/L agar, adjusted to pH 5.8) for 4-7 days at 28° C. in the dark prior to bombardment. Approximately 80-100 callus pieces, each 0.2-0.3 cm in size and totaling 1-1.5 g by weight, were arranged in the center of a Petri dish containing osmotic solid medium (CIM supplemented with 0.4 M sorbitol and 0.4 M mannitol) for a 4-hour osmotic pretreatment prior to particle bombardment. For bombardment, the macro-carriers containing the DNA-coated gold particles were assembled into a macro-carrier holder. The rupture disk (1,100 psi), stopping screen, and macro-carrier holder were assembled according to the manufacturer's instructions. The plate containing the rice callus to be bombarded was placed 6 cm beneath the stopping screen and the callus pieces were bombarded after the vacuum chamber reached 25-28 in. Hg. Following bombardment, the callus was left on osmotic medium for 16-20 hours, then the callus pieces were transferred to selection medium (CIM supplemented with 50 mg/L hygromycin and 100 mg/L timentin). The plates were transferred to an incubator and held at 28° C. in the dark to begin the recovery of transformed cells. Every two weeks, the callus was sub-cultured onto fresh selection medium. Hygromycin-resistant callus pieces began to appear after approximately five to six weeks on selection medium. Individual hygromycin-resistant callus pieces were transferred to new selection plates to allow the cells to divide and grow to produce sufficient tissue to be sampled for molecular analysis. Table 4 summarizes the combinations of DNA vectors that were used for these rice bombardment experiments.

TABLE 4

Summary of rice particle bombardment experiments

| Experiment | Cms1 Plasmid | gRNA Plasmid | Repair Donor Plasmid |
|---|---|---|---|
| 166 | 132363 | 131608 | 131632 |
| 187 | 132388 | 131608 | 131632 |
| 188 | 132389 | 131608 | 131632 |
| 189 | 132390 | 131608 | 131632 |
| 201 | 132437 | 131608 | 131632 |
| 202 | 132438 | 131608 | 131632 |
| 211 | 132439 | 131608 | 131632 |
| 212 | 132455 | 131608 | 131632 |
| 217 | 132456 | 131608 | 131632 |
| 218 | 132457 | 131608 | 131632 |
| 220 | 132463 | 131608 | 131632 |
| 221 | 132464 | 131608 | 131632 |
| 222 | 132465 | 131608 | 131632 |
| 223 | 132466 | 131608 | 131632 |
| 224 | 132470 | 131608 | 131632 |
| 231 | 132502 | 131608 | 131632 |
| 233 | 132504 | 131608 | 131632 |
| 234 | 132505 | 131608 | 131632 |
| 238 | 132506 | 131608 | 131632 |
| 239 | 132507 | 131608 | 131632 |
| 240 | 132508 | 131608 | 131632 |
| 241 | 132509 | 131608 | 131632 |
| 247 | 132510 | 131608 | 131632 |
| 248 | 132511 | 131608 | 131632 |
| 249 | 132512 | 131608 | 131632 |
| 251 | 132513 | 131608 | 131632 |
| 252 | 132514 | 131608 | 131632 |
| 253 | 132515 | 131608 | 131632 |
| 254 | 132516 | 131608 | 131632 |
| 255 | 132517 | 131608 | 131632 |
| 256 | 132518 | 131608 | 131632 |
| 257 | 132519 | 131608 | 131632 |
| 258 | 132520 | 131608 | 131632 |
| 259 | 132521 | 131608 | 131632 |
| 260 | 132522 | 131608 | 131632 |

TABLE 4-continued

Summary of rice particle bombardment experiments

| Experiment | Cms1 Plasmid | gRNA Plasmid | Repair Donor Plasmid |
|---|---|---|---|
| 261 | 132523 | 131608 | 131632 |
| 262 | 132524 | 131608 | 131632 |
| 264 | 132525 | 131608 | 131632 |
| 265 | 132526 | 131608 | 131632 |
| 266 | 132527 | 131608 | 131632 |
| 270 | 132522 | 131608 | 131592 |
| 271 | 132523 | 131608 | 131592 |
| 272 | 132524 | 131608 | 131592 |
| 273 | 132525 | 131608 | 131592 |
| 278 | 132526 | 131608 | 131592 |
| 279 | 132527 | 131608 | 131592 |
| 280 | 132528 | 131608 | 131592 |
| 283 | 132456 | 131608 | 131592 |
| 284 | 132463 | 131608 | 131592 |
| 293 | 132529 | 131608 | 131592 |
| 294 | 132530 | 131608 | 131592 |
| 295 | 132531 | 131608 | 131592 |
| 300 | 132464 | 131608 | 131592 |

Example 3

Rice Molecular Analysis

After the individual hygromycin-resistant callus pieces from each transformation experiment were transferred to new plates, they grew to a size that was sufficient for sampling. A small amount of tissue was harvested from each individual piece of hygromycin-resistant rice callus and DNA was extracted from these tissue samples for PCR, DNA sequencing, and T7 endonuclease (T7EI) analyses. The PCR analyses were designed using primers that do not produce an amplicon from wild-type rice DNA, nor from the repair donor plasmid alone, but instead have one primer binding site that lies in the rice genome outside of the homology arm and another primer binding site in the insertion cassette, and thus are indicative of an insertion event at the rice CAO1 locus.

Sanger sequencing and/or next-generation sequencing of the PCR amplicons produced from the PCR analyses described above was performed to confirm that the PCR amplicon was actually indicative of an insertion at the intended genomic locus and not simply an experimental artifact. Table 5 summarizes the results of these sequencing analyses.

TABLE 5 summary of rice callus genome editing experimental results

| Nuclease | Experiment Number | CAO1 genome edit |
|---|---|---|
| ADurb.160Cms1 (SEQ ID NO: 16, encoding SEQ ID NO: 20) | 166 | −186/+90 (SEQ ID NO: 14) |
| AuxCms1 (SEQ ID NO: 17, encoding SEQ ID NO: 21) | 187 | −344/+104 (SEQ ID NO: 28) |
| LAHSCms1 (SEQ ID NO: 18, encoding SEQ ID NO: 22) | 188 | −431 (SEQ ID NO: 29) |
| Unk1Cms1 (SEQ ID NO: 110, encoding SEQ ID NO: 30) | 201 | −431 (SEQ ID NO: 202) |
| Unk2Cms1 (SEQ ID NO: 111, encoding SEQ ID NO: 31) | 202 | −314/+116 (SEQ ID NO: 203) |
| Unk3Cms1 (SEQ ID NO: 112, encoding SEQ ID NO: 32) | 211 | −63 (SEQ ID NO: 204) |
| Unk3Cms1 (SEQ ID NO: 112, encoding SEQ ID NO: 32) | 211 | −42 (SEQ ID NO: 205) |
| Unk4Cms1 (SEQ ID NO: 113, encoding SEQ ID NO: 33) | 212 | −22 (SEQ ID NO: 13) |
| Unk7Cms1 (SEQ ID NO: 116, encoding SEQ ID NO: 36) | 217 | −26 (SEQ ID NO: 318) |
| Unk10Cms1 (SEQ ID NO: 119, encoding SEQ ID NO: 39) | 218 | −38/+257 (SEQ ID NO: 214) |
| Unk5Cms1 (SEQ ID NO: 114, encoding SEQ ID NO: 34) | 220 | −4 (SEQ ID NO: 319) |
| Unk8Cms1 (SEQ ID NO: 117, encoding SEQ ID NO: 37) | 221 | −22 (SEQ ID NO: 320) |
| Unk9Cms1 (SEQ ID NO: 118, encoding SEQ ID NO: 38) | 222 | −244 (SEQ ID NO: 208) |
| Unk11Cms1 (SEQ ID NO: 120, encoding SEQ ID NO: 40) | 223 | −216 (SEQ ID NO: 209) |
| Unk6Cms1 (SEQ ID NO: 115, encoding SEQ ID NO: 35) | 224 | −216 (SEQ ID NO: 210) |
| Unk4Cms1 (SEQ ID NO: 221, encoding SEQ ID NO: 33) | 231 | −24 (SEQ ID NO: 211) |
| Unk14Cms1 (SEQ ID NO: 122, encoding SEQ ID NO: 42) | 233 | −293 (SEQ ID NO: 207) |
| Unk15Cms1 (SEQ ID NO: 123, encoding SEQ ID NO: 43) | 234 | −124 (SEQ ID NO: 321) |
| Unk16Cms1 (SEQ ID NO: 124, encoding SEQ ID NO: 44) | 238 | −8 (SEQ ID NO: 322) |
| Unk17Cms1 (SEQ ID NO: 125, encoding SEQ ID NO: 45) | 239 | −392/+349 (SEQ ID NO: 213) |
| Unk18Cms1 (SEQ ID NO: 126, encoding SEQ ID NO: 46) | 240 | −16 (SEQ ID NO: 323) |
| Unk19Cms1 (SEQ ID NO: 127, encoding SEQ ID NO: 47) | 241 | −307/+356 (SEQ ID NO: 215) |
| Unk20Cms1 (SEQ ID NO: 128, encoding SEQ ID NO: 48) | 247 | −26 (SEQ ID NO: 324) |
| Unk21Cms1 (SEQ ID NO: 129, encoding SEQ ID NO: 49) | 248 | −305/+402 (SEQ ID NO: 216) |
| Unk22Cms1 (SEQ ID NO: 130, encoding SEQ ID NO: 50) | 249 | −26 (SEQ ID NO: 324) |
| Unk23Cms1 (SEQ ID NO: 131, encoding SEQ ID NO: 51) | 251 | −26 (SEQ ID NO: 324) |
| Unk24Cms1 (SEQ ID NO: 132, encoding SEQ ID NO: 52) | 252 | −364/+95 (SEQ ID NO: 217) |
| Unk25Cms1 (SEQ ID NO: 133, encoding SEQ ID NO: 53) | 253 | −304 (SEQ ID NO: 219) |
| Unk27Cms1 (SEQ ID NO: 135, encoding SEQ ID NO: 55) | 255 | −284/+1 (SEQ ID NO: 220) |
| Unk28Cms1 (SEQ ID NO: 136, encoding SEQ ID NO: 56) | 256 | −470/+238 (SEQ ID NO: 218) |
| Unk29Cms1 (SEQ ID NO: 137, encoding SEQ ID NO: 57) | 257 | −26 (SEQ ID NO: 324) |
| Unk30Cms1 (SEQ ID NO: 138, encoding SEQ ID NO: 58) | 258 | −26 (SEQ ID NO: 324) |
| Unk31Cms1 (SEQ ID NO: 139, encoding SEQ ID NO: 59) | 259 | −4 (SEQ ID NO: 319) |
| Unk32Cms1 (SEQ ID NO: 140, encoding SEQ ID NO: 60) | 270 | −26 (SEQ ID NO: 324) |
| Unk33Cms1 (SEQ ID NO: 141, encoding SEQ ID NO: 61) | 271 | −26 (SEQ ID NO: 324) |
| Unk34Cms1 (SEQ ID NO: 142, encoding SEQ ID NO: 62) | 272 | −26 (SEQ ID NO: 324) |
| Unk35Cms1 (SEQ ID NO: 143, encoding SEQ ID NO: 63) | 273 | −26 (SEQ ID NO: 324) |
| Unk36Cms1 (SEQ ID NO: 144, encoding SEQ ID NO: 64) | 278 | −26 (SEQ ID NO: 324) |
| Unk37Cms1 (SEQ ID NO: 145, encoding SEQ ID NO: 65) | 279 | −16 (SEQ ID NO: 323) |
| Unk38Cms1 (SEQ ID NO: 146, encoding SEQ ID NO: 66) | 280 | −29 (SEQ ID NO: 325) |

In addition to the PCR and DNA sequencing analyses, T7EI analyses were performed to detect the presence of small insertions and/or deletions at the CAO1 locus. T7EI analyses were performed as described previously (Begemann et al. (2017) Sci Reports 7:11606). For callus samples whose T7EI analyses were indicative of a potential insertion or deletion, DNA sequencing analyses were performed to detect the presence of insertions and/or deletions at the CAO1 locus.

Example 4

Regeneration of Rice Plants with a Genetic Modification at the CAO1 Locus

Rice callus transformed as described above is cultured on tissue culture medium to produce shoots. These shoots are subsequently transferred to rooting medium, and the rooted plants are transferred to soil for cultivation in a greenhouse. DNA is extracted from the rooted plants for PCR and DNA sequencing analyses. T0-generation plants are grown to maturity and self-pollinated to produce T1-generation seeds. These T1-generation seeds are planted and the resulting T1-generation plants are genotyped to identify homozygous, hemizygous, and null segregant plants. The plants are phenotyped to detect the yellow leaf phenotype associated with a homozygous knockout of the CAO1 gene (Lee et al. (2005) Plant Mol Biol 57:805-818).

Example 5

Editing Pre-Determined Genomic Loci in Maize (Zea mays)

One or more gRNAs is designed to anneal with a desired site in the maize genome and to allow for interaction with one or more Cms1 proteins. These gRNAs are cloned in a vector such that they are operably linked to a promoter that is operable in a plant cell (the "gRNA cassette"). One or more genes encoding a Cms1 protein is cloned in a vector such that they are operably linked to a promoter that is operable in a plant cell (the "Cms1 cassette"). The gRNA cassette and the Cms1 cassette are cloned into a single vector, or alternatively are cloned into two separate vectors that are suitable for plant transformation, and this vector or these vectors are subsequently transformed into *Agrobacterium* cells. These cells are brought into contact with maize tissue that is suitable for transformation. Following this incubation with the *Agrobacterium* cells, the maize cells are cultured on a tissue culture medium that is suitable for regeneration of intact plants. Maize plants are regenerated from the cells that were brought into contact with *Agrobacterium* cells harboring the vector that contained the Cms1 cassette and gRNA cassette. Following regeneration of the maize plants, plant tissue is harvested and DNA is extracted from the tissue. T7EI assays, PCR assays, and/or sequencing assays are performed, as appropriate, to determine whether a change in the DNA sequence has occurred at the desired genomic location.

Alternatively, particle bombardment is used to introduce the Cms1 cassette and gRNA cassette into maize cells. A single vector containing a Cms1 cassette and a gRNA cassette, or separate vectors containing a Cms1 cassette and a gRNA cassette, respectively, are coated onto gold beads or titanium beads that are then used to bombard maize tissue that is suitable for regeneration. Following bombardment, the maize tissue is transferred to tissue culture medium for regeneration of maize plants. Following regeneration of the maize plants, plant tissue is harvested and DNA is extracted from the tissue. T7EI assays, PCR assays, and/or sequencing assays are performed, as appropriate, to determine whether a change in the DNA sequence has occurred at the desired genomic location.

Example 6

Computational Analyses of Cms1 Nucleases and Other Type V Nucleases

CRISPR nucleases are often classified by type, with, e.g., Cas9 nucleases classified as Type II nucleases and Cpf1 nucleases classified as Type V (Koonin et al. (2017) Curr Opin Microbial 37:67-78). Examination of Cms1 nuclease protein sequences suggests that these nucleases should be grouped as Type V nucleases based in part on the presence of a RuvC domain and absence of an HNH domain. Multiple groups of Type V nucleases have been described in the scientific literature to date, including Cpf1 (also referred to as Type V-A), C2c1 (also referred to as Type V-B), C2c3 (also referred to as Type V-C), CasY (also referred to as Type V-D), and CasX (also referred to as Type V-E).

MUSCLE alignments of Type V amino acid sequences typically failed to correctly align the catalytic residues of the RuvCI, RuvCII, and RuvCIII domains in these proteins. Given the central importance of these domains in the function of the proteins, correct alignment of these residues is imperative. The RuvCI, RuvCII, and RuvCIII catalytic residues were identified for the amino acid sequences of the Cms1 nucleases disclosed herein and in U.S. Pat. No. 9,896,696 (SEQ ID NOs:10, 11, 20-23, 30-69, and 154-156), three Cpf1 nucleases (SEQ ID NOs:147-149), C2c1 nucleases (SEQ ID NOs:150 and 157-164), C2c3 nucleases (SEQ ID NOs:152 and 166-168) (Shmakov et al. (2016) Mol Cell 60:385-397), CasX nucleases (SEQ ID NOs:151 and 165), and CasY nucleases (SEQ ID NOs:153 and 169-173) (Burstein et al. (2017) Nature 542:237-241). Table 6 shows the catalytic residue for each of these domains as well as the three amino acids immediately preceding the catalytic residue and the three amino acids immediately following the catalytic residue.

TABLE 6 summary of RuvCI, RuvCII, and RuvCIII catalytic residues for Type V nucleases

| Protein | RuvCI | RuvCII | RuvCIII |
|---|---|---|---|
| MicroCms1 (SEQ ID NO: 154) | YGIDRGL | IALENLD | HNSDDVA |
| ObCms1 (SEQ ID NO: 155) | FGIDRGN | VALENLA | NSPDTVA |
| Sm17Cms1 (SEQ ID NO: 156) | YGIDAGE | ISIEDLK | DSNDKVA |

TABLE 6-continued

Summary of RuvCI, RuvCII, and RuvCIII catalytic residues for Type V nucleases

| Protein | RuvCI | RuvCII | RuvCIII |
|---|---|---|---|
| SmCms1 (SEQ ID NO: 10) | YGIDAGE | ISIEDLK | NDPDKVA |
| ADurb.160Cms1 (SEQ ID NO: 20) | YGIDKGT | ICYETLN | ESGDDLA |
| Sm82Cms1 (SEQ ID NO: 23) | FGIDVGN | IVLEYLT | DGPDKVA |
| Unk1Cms1 (SEQ ID NO: 30) | YGIDRGL | IALENLD | NNSDEVA |
| Unk3Cms1 (SEQ ID NO: 32) | YGLDRGQ | IVFEGLD | DNSDSVA |
| Unk4Cms1 (SEQ ID NO: 33) | FGVDTGE | IAIENLA | HSNDAVA |
| Unk5Cms1 (SEQ ID NO: 34) | YGLDRGE | ISLENLE | NSSDDIA |
| Unk8Cms1 (SEQ ID NO: 37) | YGIDRGQ | INLENLI | KNSDEVA |
| Unk9Cms1 (SEQ ID NO: 38) | YGIDRGN | VVLEDLN | NDPDKIA |
| Unk10Cms1 (SEQ ID NO: 39) | FGIDVGT | VVLENLK | DTNDKIA |
| Unk15Cms1 (SEQ ID NO: 43) | LGIDNGE | IIKEGFD | HSNDGIA |
| Unk16Cms1 (SEQ ID NO: 44) | YGIDRGQ | INLENLH | KNSDDVA |
| Unk18Cms1 (SEQ ID NO: 46) | YGIDRGL | IALENLD | HNSDDVA |
| Unk19Cms1 (SEQ ID NO: 47) | YGIDAGE | ISIEDLK | DSNDKVA |
| Unk20Cms1 (SEQ ID NO: 48) | YGIDRGL | IAFEDMD | DDSDKVA |
| Unk21Cms1 (SEQ ID NO: 49) | LGIDNNE | IVKEGFD | HSNDGIA |
| Unk22Cms1 (SEQ ID NO: 50) | YGIDRGQ | ITLEDLD | KNSDDVA |
| Unk23Cms1 (SEQ ID NO: 51) | YGIDRGE | IYFEEKN | NSGDDLA |
| Unk24Cms1 (SEQ ID NO: 52) | YGLDKGT | ICFETLD | KSGDDLA |
| Unk25Cms1 (SEQ ID NO: 53) | LGIDNGE | VVKEGFG | HSNDGIA |
| Unk26Cms1 (SEQ ID NO: 54) | FGIDNGE | IIKEGFD | HSNDGIA |
| Unk27Cms1 (SEQ ID NO: 55) | FGIDNGE | IVKEGFG | HSNDEIA |
| Unk28Cms1 (SEQ ID NO: 56) | CGIDIGE | VVLENIP | KSCDIVA |
| Unk29Cms1 (SEQ ID NO: 57) | FGIDSGE | IAKEGFD | HSNDGVA |
| Unk30Cms1 (SEQ ID NO: 58) | FGIDNGE | IVKEGFD | HSNDGIA |
| Unk31Cms1 (SEQ ID NO: 59) | LGIDNGE | VVKEAFD | HRNDGIA |
| Unk32Cms1 (SEQ ID NO: 60) | YGIDRGD | MFLENKK | KSGDDLA |
| Unk39Cms1 (SEQ ID NO: 67) | FGIDNGE | IAKEGFG | HSNDGIA |
| Unk42Cms1 (SEQ ID NO: 208) | LGIDNGE | IVKEGFD | HSNDGVA |
| Unk43Cms1 (SEQ ID NO: 209) | YGLDKGT | IVREGLG | KSGDDLA |
| Unk44Cms1 (SEQ ID NO: 210) | IGIDTGT | IAFEGFD | DCNDKVA |
| Unk45Cms1 (SEQ ID NO: 211) | FGIDRGN | INLENLH | DNSDSVA |
| Unk46Cms1 (SEQ ID NO: 222) | YFIDIWE | IIISNFI | unclear |
| Unk47Cms1 (SEQ ID NO: 223) | FGIDNGE | IIKEGFG | HSNDGIA |
| Unk49Cms1 (SEQ ID NO: 225) | YGIDRGD | INLENLH | KNSDDVA |
| Unk52Cms1 (SEQ ID NO: 228) | YGIDRGS | VVLENLK | SDPDKIA |
| Unk54Cms1 (SEQ ID NO: 229) | FGLDNGE | IVKEGFD | HSNDGIA |

TABLE 6-continued summary of RuvCI, RuvCII, and RuvCIII catalytic residues for Type V nucleases

| Protein | RuvCI | RuvCII | RuvCIII |
|---|---|---|---|
| LbCms1Cms1 (SEQ ID NO: 232) | YGIDVGQ | IFLEDLK | DNPDSLA |
| Unk58Cms1 (SEQ ID NO: 234) | YGIDRGI | IYLENLE | INYDSIA |
| Unk60Cms1 (SEQ ID NO: 236) | YGLDRGK | MCFENLN | DNSDSVA |
| Unk61Cms1 (SEQ ID NO: 237) | YWIDKWT | ICYETLD | KSWDDLA |
| Unk65Cms1 (SEQ ID NO: 241) | YGIDTGI | ITIEYLD | DSNDKVA |
| Unk67Cms1 (SEQ ID NO: 243) | YWIDKWD | MFLENKK | KSWDDLA |
| Unk69Cms1 (SEQ ID NO: 245) | LGIDNGE | IVKEGFD | HSNNGVA |
| Unk72Cms1 (SEQ ID NO: 248) | YGIDRGQ | INLENLT | KNSDEVA |
| Unk74Cms1 (SEQ ID NO: 250) | FGIDTGE | IAIENLA | HSNDAVA |
| Unk75Cms1 (SEQ ID NO: 251) | YWFDKWE | FVFEDKT | HSWDDLA |
| Unk77Cms1 (SEQ ID NO: 253) | YGIDRGI | IFLENLD | LNYDSIA |
| Unk78Cms1 (SEQ ID NO: 254) | YGIDRGE | IILEDIE | DDPDKVA |
| Unk79Cms1 (SEQ ID NO: 41) | YGLDRGK | VAFENLD | DNSDKVA |
| SulfCms1 (SEQ ID NO: 11) | IGIDRGL | ISLEDLS | HNGDDNG |
| AuxCms1 (SEQ ID NO: 21) | IGIDRGQ | ISLEDLS | KSGDDNA |
| DAHSCms1 (SEQ ID NO: 22) | FGIDRGQ | ISLEDLS | KSGDDNA |
| Unk2Cms1 (SEQ ID NO: 31) | FGIDRGQ | ISLEDLS | KSGDDNA |
| Unk6Cms1 (SEQ ID NO: 35) | FGIDRGQ | ISLEDLT | KSGDDNA |
| Unk7Cms1 (SEQ ID NO: 36) | IGIDRGL | ISIENLT | SNGDENG |
| Unk11Cms1 (SEQ ID NO: 40) | IGIDRGI | IALEDLT | TDGDQNG |
| Unk14Cms1 (SEQ ID NO: 42) | FGIDRGI | ISLENLS | KNGDDNA |
| Unk17Cms1 (SEQ ID NO: 45) | FGIDRGL | ISLEDLT | QNGDENG |
| Unk33Cms1 (SEQ ID NO: 61) | IGIDRGI | IALEDLT | TDGDQNG |
| Unk34Cms1 (SEQ ID NO: 62) | FGIDRGQ | IALEDLT | KSGDDNA |
| Unk35Cms1 (SEQ ID NO: 63) | IGIDRGL | VSLEDLS | HNGDDNG |
| Unk36Cms1 (SEQ ID NO: 64) | FGIDRGQ | ISLEDLS | KSGDDNA |
| Unk37Cms1 (SEQ ID NO: 65) | FGIDRGI | ITLENLN | KNGDDNA |
| Unk38Cms1 (SEQ ID NO: 66) | IGIDRGL | VSLEDLS | HNGDDNG |
| Unk41Cms1 (SEQ ID NO: 69) | YGIDRGI | IVLENIA | RSGDQSA |
| Unk51Cms1 (SEQ ID NO: 227) | FGIDRGQ | IALEDLT | KNGDDNA |
| Unk55Cms1 (SEQ ID NO: 230) | FGIDRGI | ISFEDLT | TNGDDNG |
| Unk56Cms1 (SEQ ID NO: 231) | IGIDRGI | IALEDLT | TDGDQNG |
| Unk59Cms1 (SEQ ID NO: 235) | FGIDSWI | ISLEDLS | KNWDDNG |
| Unk63Cms1 (SEQ ID NO: 239) | FGIDSWI | ISLENLS | KNGDDNA |
| Unk64Cms1 (SEQ ID NO: 240) | FGIDSWI | ISLENLS | NNYKKQC |
| Unk66Cms1 (SEQ ID NO: 242) | FGIDSWI | ISLEDLS | KNWDDNG |
| Unk68Cms1 (SEQ ID NO: 244) | FGIDSWI | ISLEDLS | KNGDDNG |

TABLE 6-continued summary of RuvCI, RuvCII, and RuvCIII catalytic residues for Type V nucleases

| Protein | RuvCI | RuvCII | RuvCIII |
|---|---|---|---|
| Unk71Cms1 (SEQ ID NO: 247) | FGIDSWI | IVLENLS | KNWDDNG |
| Unk40Cms1 (SEQ ID NO: 68) | VGLDRGE | VSLENLN | NGGDVLA |
| Unk48Cms1 (SEQ ID NO: 224) | IGLDRGE | VSLENLN | TGGDTLA |
| Unk50Cms1 (SEQ ID NO: 226) | VGIDLGE | IVFENLD | KSCDEIA |
| Unk57Cms1 (SEQ ID NO: 233) | IGLDRGE | VSFENLN | NGGDVLA |
| Unk62Cms1 (SEQ ID NO: 238) | IGIDLGE | IVFENLD | KSCDEIA |
| Unk70Cms1 (SEQ ID NO: 246) | IGIDLWE | IVFENLD | KSCDEIA |
| Unk73Cms1 (SEQ ID NO: 249) | LGMDRGE | IVLEDLD | KTGDDLA |
| Unk76Cms1 (SEQ ID NO: 252) | IGLDRGE | FIFENQT | KSGDNLA |
| AsCpf1 (SEQ ID NO: 148) | IGIDRGE | VVLENLN | MDADANG |
| FnCpf1 (SEQ ID NO: 147) | LSIDRGE | VVFEDLN | QDADANG |
| LbCpf1 (SEQ ID NO: 149) | IGIDRGE | IALEDLN | KNADANG |
| CasY.1 (SEQ ID NO: 153) | LGLDVGE | IIYEISI | TDADIQA |
| CasY.2 (SEQ ID NO: 172) | MGIDIGE | PVYEFEI | SDADIQA |
| CasY.3 (SEQ ID NO: 173) | IGIDIGE | LSFEYEV | SHADKQA |
| CasY.4 (SEQ ID NO: 169) | LGIDIGE | IVYELEV | ADADIQA |
| CasY.5 (SEQ ID NO: 171) | AVVDVLD | AANELHR | unclear |
| CasY.6 (SEQ ID NO: 170) | LGLDAGE | VVHEESV | unclear |
| CasX_Delta (SEQ ID NO: 151) | IGVDRGE | LVFENLS | VHADEQA |
| CasX_Plancto (SEQ ID NO: 165) | IGIDRGE | LIFENLS | THADEQA |
| C2c3_AUXO (SEQ ID NO: 152) | VSIDQGE | PILEKQV | QHADVNA |
| C2c3_CEVA (SEQ ID NO: 167) | VAIDLGE | PVLESSV | CHADENA |
| C2c3_CEPX (SEQ ID NO: 166) | VAIDLGE | PVLEFQI | GHADENA |
| C2c3_CEPS (SEQ ID NO: 168) | LAIDLGE | PVLESSV | GHADENA |
| AcoC2c1 (SEQ ID NO: 157) | MSVDLGV | ILFEDLS | VHADINA |
| ObC2c1 (SEQ ID NO: 160) | LGVDLGT | VVIENLS | MQADLNA |
| DbC2c1 (SEQ ID NO: 164) | LSVDLGH | VVIENLA | IHADLNA |
| DiC2c1 (SEQ ID NO: 158) | LSVDLGM | ILFEDLA | IHADMNA |
| DtC2c1 (SEQ ID NO: 159) | LSVDLGV | ILFEDLA | IHADINA |
| AacC2c1 (SEQ ID NO: 150) | MSVDLGL | ILLEELS | IHADLNA |
| Bsp1C2c1 (SEQ ID NO: 163) | MSIDLGL | ILFENLS | LQADINA |
| TcC2c1 (SEQ ID NO: 161) | MSVDLGQ | VLFEDLS | THADINA |
| BtC2c1 (SEQ ID NO: 162) | MSIDLGQ | ILFEDLS | THADINA |

Sequence alignments and other computational analyses did not show clear RuvCIII catalytic residues for CasY.5 or CasY.6. The putative catalytic residues in Unk64 and Unk69 are a lysine and an asparagine, respectively, while all others have an invariant aspartic acid residue at this position. For the remaining Type V nucleases, the RuvC catalytic residues summarized in Table 6 were used to generate RuvC-anchored sequence alignments in which the catalytic residues served as fixed anchors, using methods described previously (Begemann et al. (2017) *BioRxiv* doi: 10.1101/192799). The resulting RuvC-anchored amino acid alignments were used to construct a phylogenetic tree, shown in FIG. 1. As this figure shows, the Cms1 nucleases are on separate clades from the other Type V nucleases. Further, there are at least three separate groups of Cms1 nucleases that cluster together in this analysis (in Table 6, these groups comprise MicroCms1through Unk78Cms1, SulfCms1 through Unk71Cms1, and Unk40Cms1 through Unk76Cms1, respectively), suggesting the existence of at least three groups of Cms1 nucleases within this larger grouping. These three groups are labeled as "Sm-type," "Sulf-type," and "Unk40-type," respectively, for the groups of nucleases that include SmCms1 (SEQ ID NO:10), SulfCms1 (SEQ ID NO:11), and Unk40Cms1 (SEQ ID NO:68), respectively.

Figure 2:
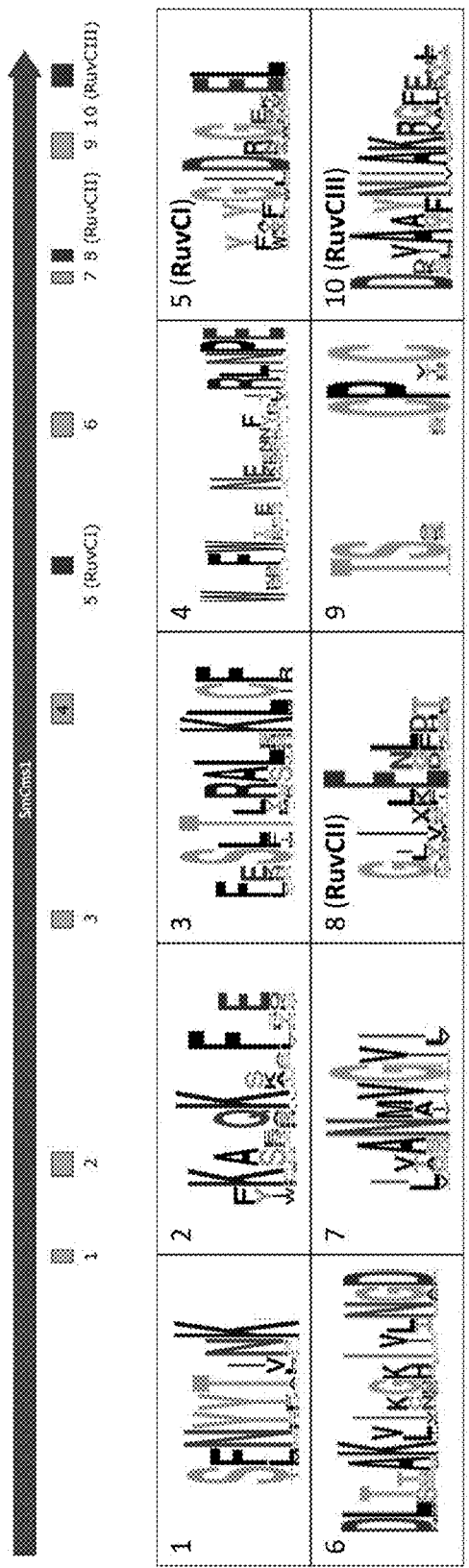
FIG. 2 shows a summary of amino acid motifs shared among Sm-type Cms1 proteins. The weblogo figures in boxes 1-10 correspond to SEQ ID NOs:177-186, respectively, and their locations on the SmCms1 protein (SEQ ID NO:10) are shown.
Figure 3:
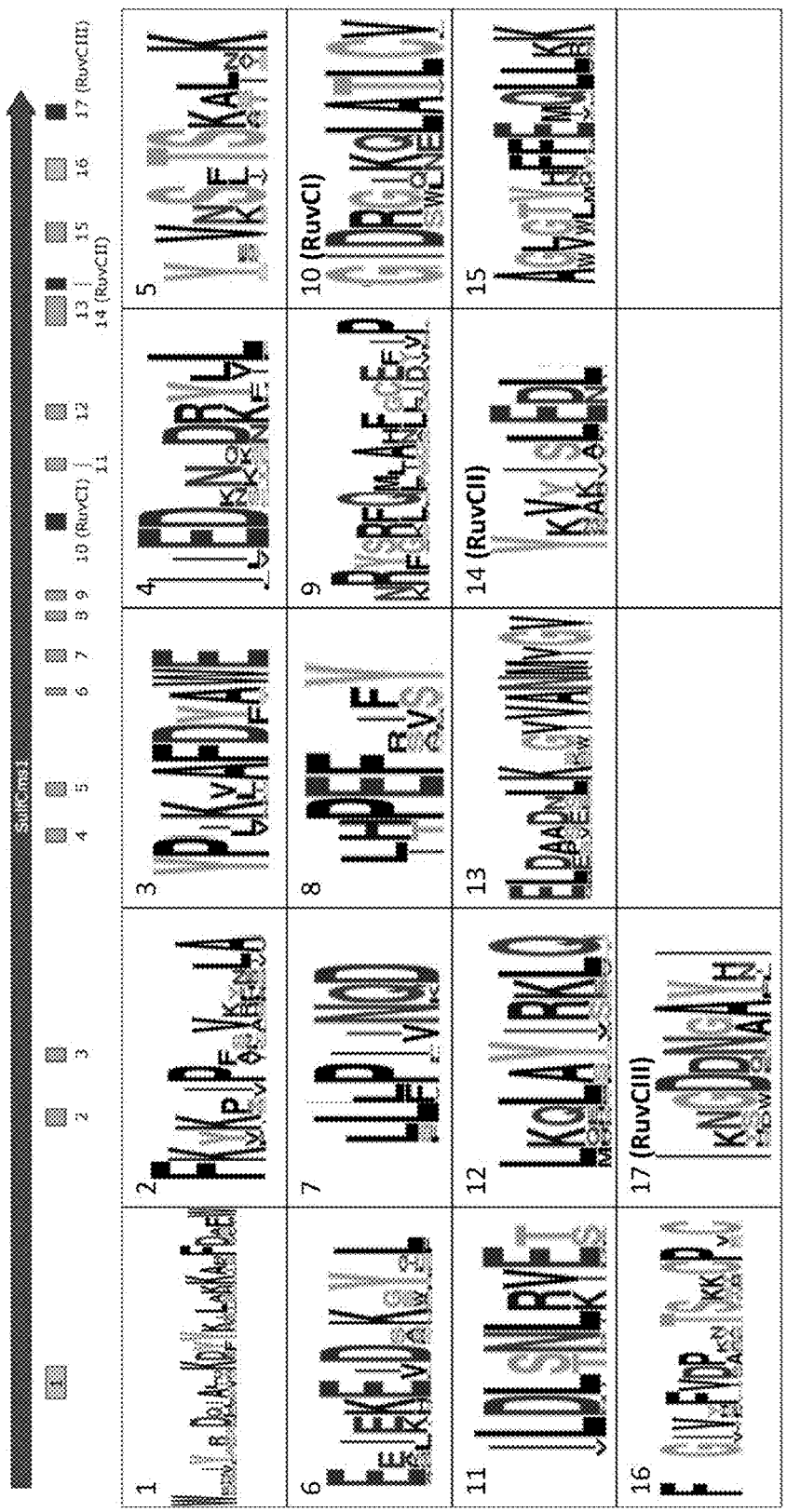
FIG. 3 shows a summary of amino acid motifs shared among Sulf-type Cms1 proteins. The weblogo figures in boxes 1-17 correspond to SEQ ID NOs: 288-289 and SEQ ID NOs:187-201, respectively, and their locations on the SulfCms1 protein (SEQ ID NO:11) are shown.
Figure 4:
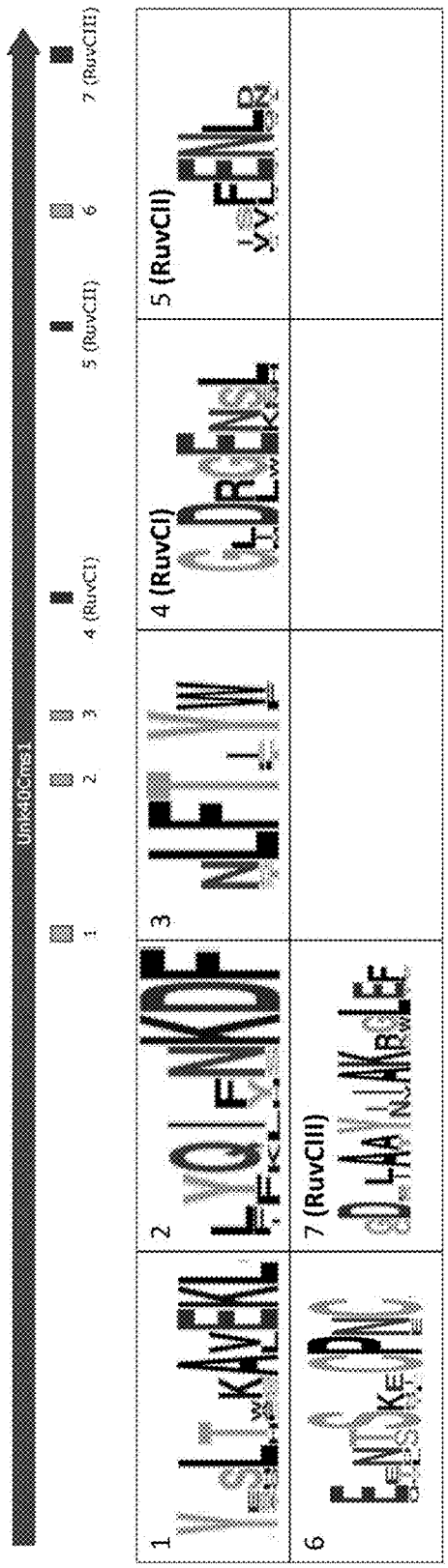
FIG. 4 shows a summary of amino acid motifs shared among Unk40-type Cms1 proteins. The weblogo figures in boxes 1-7 correspond to SEQ ID NOs: 290-296, respectively, and their locations on the Unk40Cms1 protein (SEQ ID NO:68) are shown.

Cms1 nuclease amino acid sequence alignments were examined to identify motifs within the protein sequences that are well-conserved among these nucleases. It was observed that Cms1 nucleases were found in three fairly well-separated clades on the phylogenetic tree shown in FIG. 1. One of these clades includes SmCms1 (SEQ ID NO:10), another includes SulfCms1 (SEQ ID NO:11), and another includes Unk40Cms1 (SEQ ID NO:68). Members of each of these clades were therefore aligned separately to identify partially and/or completely conserved amino acid motifs among these nucleases. For the alignment of SmCms1-like nucleases, SEQ ID NOs:10, 20, 23, 30, 32-34, 37-39, 41, 43, 44, 46-60, 67, 154-156, 208-211, 222, 223, 225, 228, 229, 232, 234, 236, 237, 241, 243, 245, 248, 250, 251, 253, and 254 were aligned. For the alignment of SulfCms1-like nucleases, SEQ ID NOs:11, 21, 22, 31, 35, 36, 40, 42, 45, 61-66, 69, 227, 230, 231, 235, 239, 240, 242, 244, and 247 were aligned. For the alignment of Unk40-like nucleases, SEQ ID NOs: 68, 224, 226, 233, 238, 246, 249, and 252 were aligned. These alignments were performed using MUSCLE and the resulting alignments were examined manually to identify regions that showed conservation among all of the aligned proteins. The amino acid motifs shown in SEQ ID NOs:177-186 were identified from the alignment of SmCms1-like nucleases; the amino acid motifs shown in SEQ ID NOs:288-289 and 187-201 were identified from the alignment of SulfCms1-like nucleases; the amino acid motifs shown in SEQ ID NOs:290-296 were identified from the alignment of Unk40Cms1-like nucleases. Weblogos were created using the sequence alignments and are depicted graphically in FIGS. 2-4 (SmCms1-like, SulfCms1-like, and Unk40Cms1-like sequence motifs, respectively; weblogo.berkeley.edu) along with schematic diagrams showing the locations of these conserved motifs on the SmCms1, SulfCms1, and Unk40Cms1 protein sequences.

Editing of plant genomes with Cms1 nucleases as described herein suggested that, consistent with some other descriptions of Type V nucleases, TTTN or TTN PAM sites were accessible by many if not all Cms1 nucleases. Computational analyses were performed to identify BLAST hits that corresponded to CRISPR spacers present on the contigs that encoded Cms1 nucleases. CRISPR spacers were identified using CRISPRfinder online (crispr.i2bc.paris-saclay.fr/Server/); these spacers were used as seeds for BLAST searches against metagenomes. BLAST hits were identified for CRISPR spacers from the contigs that encode AuxCms1, Unk15Cms1, Unk19Cms1, and Unk40Cms1 (SEQ ID NOs: 297-300, respectively). These BLAST hits are shown in SEQ ID NOs:301-307 and summarized in Table 7 along with the nucleotides that precede and follow the BLAST hits.

TABLE 7 summary of BLAST hits with CRISPR spacers from Cms1-encoding contigs

| Contig with CRISPR spacer | BLAST hit and surrounding nucleotides | SEQ ID NO | Nucleotide positions of BLAST hit |
|---|---|---|---|
| Aux (SEQ ID NO: 297) | CTCTTATGGTACAGACGGGTCATGAATGTAACGCTGTCCAG | 301 | 2896-2923 |
| Unk15 (SEQ ID NO: 298) | CTTTTATTGCGGATTTGCTCAATGCAACGTTCTCTAATAAA | 302 | 5486-5513 |
| Unk15 (SEQ ID NO: 298) | CATTTAGAGGAAATCTATAGTCATGTTTTGTTAAGAGATTT | 303 | 1971-1999 |
| Unk19 (SEQ ID NO: 299) | TCTTTACCAAGTCCCCCCGCAACATCATAAAACATTTTAGA | 304 | 4823-4850 |
| Unk19 (SEQ ID NO: 299) | TATTTCTAGCAACCCACTCAGCATAATCGTTTTCCGGAACG | 304 | 5831-5859 |
| Unk19 (SEQ ID NO: 299) | CCATTAACCTGGCGGAGGCTAACCCTCCGCCTATAAACAAA | 305 | 1487-1514 |
| Unk19 (SEQ ID NO: 299) | ACTTTAGAATACTTATCAATAACCTGCTCTTCGGTTTGGTT | 306 | 725-752 |
| Unk40 (SEQ ID NO: 300) | CGTTTATATTCGGTTGCCACTCCTCGAAGTATTGCTTATAG | 307 | 209-236 |
| Unk54 (SEQ ID NO: 308) | CTTTTAATCCACGCGCCGCCCACTATGATAACTTGCCGGAA | 309 | 6064-6092 |
| Unk54 (SEQ ID NO: 308) | TGGTTAATAATTCATTGTTTATTTTTGGGTTAAAAATTTCG | 310 | 4102-4131 |
| Unk54 (SEQ ID NO: 308) | TCGTTAATAATTGGTGAATATGATTTACAACAAATGGCTGC | 311 | 17-44 |

In Table 7, the underlined bases represent the CRISPR spacer BLAST hit. Notably, the bases immediately 5' of the BLAST hits all show TTA or TTC, and 7 of the 11 BLAST hits in this table show TTTA or TTTC. These data, combined with the plant genome editing data described above, strongly suggests that at least these Cms1 nucleases (and possibly most or all Cms1 nucleases) can access target sites downstream from at least TTM PAM sites with a preference for TTTM PAM sites. Notably, these types of computationally-identified PAM sites take into account not only nuclease PAM requirements, but also the CRISPR spacer acquisition machinery requirements, so it is possible that the nucleases may be able to access a broader set of PAM sites than those computationally identified here.

SEQUENCE LISTING (325 sequences)

SEQ ID NO: 1 - protein, 9 aa, Simian Virus 40
  MISC_FEATURE (1)..(9): Nuclear localization signal
MAPKKKRKV

SEQ ID NO: 2 - DNA, 27 bp, Simian Virus 40
  misc_feature (1)..(27)
  misc_feature (1)..(27): Nuclear localization signal
atggccccaaagaagaaacggaaggtt

SEQ ID NO: 3 - DNA, 780 bp, Cauliflower mosaic virus
  promoter (1)..(780): 2X35S promoter
atggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctct

SEQ ID NO: 4 - DNA, 209 bp, Cauliflower mosaic virus
  terminator (1)..(209): 35S polyA terminator
gatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 5 - DNA, 516 bp, Oryza sativa
  promoter (1)..(516): OsU6 promoter
tttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagctt

SEQ ID NO: 6 - DNA, 12 bp, Oryza sativa
  terminator (1)..(12): OsU6 terminator
tttttttgtttt

SEQ ID NO: 7 - DNA, 1026 bp, Escherichia coli
  misc_feature (1)..(1026): hygromycin resistance gene
atgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgttcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatag

SEQ ID NO: 8 - protein, 341 aa, Escherichia coli
  MISC_FEATURE (1)..(341): hygromycin resistance protein
MKKPELTATSVEKFLIEKFDSVSDLMQLSEGEESRAFSFDVGGRGYVLRVNSCADGFYKDRYVYRHFASAALPIPEVLDIGEFSESLTYCISRRSQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPRAKK

SEQ ID NO: 9 - DNA, 1993 bp, Zea mays
  promoter (1)..(1993): ZmUbi promoter and 5'UTR
cagcaagcttctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatactactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgtta

SEQ ID NO: 10 - protein, 1064 aa, Smithella sp. SCADC
  MISC_FEATURE (1)..(1064): Csm1
  MISC_FEATURE (701)..(701): RuvCI active site
  MISC_FEATURE (922)..(922): RuvCII active site
  MISC_FEATURE (1045)..(1045): RuvCIII active site
MEKYKITKTIRFKLLPDKIQDISRQVAVLQNSTNAEKKNNLLRLVQRGQELPKLLNEYIRYSDNHKLKSNVTVHFRWLRLFTKDLFYNWKKDNTEKKIKISDVVYLSHVFEAFLKEWESTIERVNADCNKPEESKTRDAEIALSIRKLGIKHQLPFIKGFVDNSNDKNSEDTKSKLTALLSEFEAVLKICEQNYLPSQSSGIAIAKASFNYYTINKKQKDFEAEIVALKKQLHARYGNKKYDQLLRELNLIPLKELPLKELPLIEFYSEIKKRKSTKKSEFLEAVSNGLVFDDLKSKFPLFQTESNKYDEYLKLSNKITQKSTAKSLLSKDSPEAQKLQTEITKLKKNRGEYFKKAFGKYVQLCELYKEIAGKRGKLKGQIKGIENERIDSQRLQYWALVLEDNLKHSLILIPKEKTNELYRKVWGAKDDGASSSSSSTLYYFESMTYRALRKLCFGINGNTFLPEIQKELPQYNQKEFGEFCFHKSNDDKEIDEPKLISFYQSVLKTDFVKNTLALPQSVFNEVAIQSFETRQDFQIALEKCCYAKKQIISESLKKEILENYNTQIFKITSLDLQRSEQKNLKGHTRIWNRFWTKQNEEINYNLRLNPEIAIVWRKAKKTRIEKYGERSVLYEPEKRNRYLHEQYTLCTTVTDNALNNEITFAFEDTKKKGTEIVKYNEKINQTLKKEFNKNQLWFYGIDAGEIELATLALMNKDKEPQLFTVYELKKLDFFKHGYIYNKERELVIREKPYKAIQNLSYFLNEELYEKTFRDGKFNETYNELFKEKHVSAIDLTTAKVINGKIILNGDMITFLNLRILHAQRKIYEELIENPHAELKEKDYKLYFEIEGKDKDIYISRLDFEYIKPYQEISNYLFAYFASQQINEAREEEQINQTKRALAGNMIGVIYYLYQKYRGIISIEDLKQTKVESDRNKFEGNIERPLEWALYRKFQQEGYVPPISELIKLRELEKFPLKDVKQPKYENIQQFGIIKFVSPEETSTTCPKCLRRFKDYDKNKQEGFCKCQCGFDTRNDLKGFEGLNDPDKVAAFNIAKRGFEDLQKYK

SEQ ID NO: 11 - protein, 1232 aa, Sulfuricurvum sp. PC08-66
  MISC_FEATURE (1)..(1232): Csm1
  MISC_FEATURE (848)..(848): RuvCI active site
  MISC_FEATURE (1063)..(1063): RuvCII active site
  MISC_FEATURE (1213)..(1213): RuvCIII active site
MLHAFTNQYQLSKTLRFGATLKEDEKKCKSHEELKGFVDISYENMKSSATIAESLNENELVKKCERCYSEIVKFHNAWEKIYYRTDQIAVYKDFYRQLSRKARFDAGKQNSQLITLASLCGMYQGAKLSRYITNYWKDNITRQKSFLKDFSQQLHQYTRALEKSDKAHTKPNLINFNKTFMVLANLVNEIVIPLSNGAISFPNISKLEDGEESHLIEFALNDYSQLSELIGELKDAIATNGGYTPFAKVTLNHYTAEQKPHVFKNDIDAKIRELKLIGLVETLKGKSSEQIEEYFSNLDKFSTYNDRNQSVIVRTQCFKYKPIPFLVKHQLAKYISEPNGWDEDAVAKVLDAVGAIRSPAHDYANNQEGFDLNHYPIKVAFDYAWEQLANSLYTTVTFPQEMCEKYLNSIYGCEVSKEPVFKFYADLLYIRKNLAVLEHKNNLPSNQEEFICKINNTFENIVLPYKISQFETYKKDILAWINDGHDHKKYTDAKQQLGFIRGGLKGRIKAEEVSQKDKYGKIKSYYENPYTKLTNEFKQISSTYGKTFAELRDKFKEKNEITKITHFGIIIEDKNRDRYLLASELKHEQINHVSTILNKLDKSSEFITYQVKSLTSKTLIKLIKNHTTKKGAISPYADFHTSKTGFNKNEIEKNWDNYKREQVLVEYVKDCLTDSTMAKNQNWAEFGWNFEKCNSYEDIEHEIDQKSYLLQSDTISKQSIASLVEGGCLLLPIINQDITSKERKDKNQFSKDWNHIFEGSKEFRLHPEFAVSYRTPIEGYPVQKRYGRLQFVCAFNAHIVPQNGEFINLKKQIENFNDEDVQKRNVTEFNKKVNHALSDKEYVVIGIDRGLKQLATLCVLDKRGKILGDFEIYKKEFVRAEKRSESHWEHTQAETRHILDLSNLRVETTIEGKKVLVDQSLTLVKKNRDTPDEEATEENKQKIKLKQLSYIRKLQHKMQTNEQDVLDLINNEPSDEEFKKRIEGLISSFGEGQKYADLPINTMREMISDLQGVIARGNNQTEKNKIIELDAADNLKQGIVANMIGIVNYIFAKYSYKAYISLEDLSRAYGGAKSGYDGRYLPSTSQDEDVDFKEQQNQMLAGLGTYQFFEMQLLKKLQKIQSDNTVLRFVPAFRSADNYRNILRLEETKYKSKPFGVVHFIDPKFTSKKCPVCSKTNVYRDKDDILVCKECGFRSDSQLKERENNIHYIHNGDDNGAYHIALKSVENLIQMK

SEQ ID NO: 12 - DNA, 2723 bp, Oryza sativa
  misc_feature (1)..(2723): CAO1 locus
agtatgtattttatattaaaaatattgctatattttctataaatttaattagactggacaagtttgacatgaataaagtcaaagcgggttataaaatgaggaagtatcgtccattccctcgttaaaaaaagcaatttgtaactatagttatgaacgagtactggtcatgtctagattttatttatagccatttcgttttgggtcgagagcagagggaatatcttgcatgtaagtaaacatagagttaaatcaaagacatttgttcagttgtaccatattcaacatacctatagctttgaagctaccgaaattcttgtagcggacagcagcaagtgccgaaaaattctacttcatccgtttcacaatgtaagtcattttagtatttttcatattcatattaatgttaatgaatctaaatatatatatatatatgtctagattcattaacattaatatgaatgtgggaaatgcgaatgacttacattttaaaacggagggagtaccgccaaacgtaatattaccaggttggaggaccgatctgaaaaatattccgtgcaagtacacattggacgtggaccgcattgcatacaagtacaagagttgaaacgcttggttctcgaggctgccacgtcagagcttgagccttcgaagcgatcccacgtggcagcacgtggaaggctcgtggagatcgcgggcagctccccgcctcttatcgacagggccacctcgcccgcgaaaattattatttttttcgccttcctttaataatacgcacgtatttatacgatcttacttaagcgagcaccattagcatgccacgtgtcaccgtaacaatctacgtagaccccgcaagtatttgtattcactaaactttcgtaaacgaaacttgcaaaacacatcaaaccggtcaaatttggacagaaaattcagccgagatcgcaaatattcgtttcaaaacaaattactgtaaccggcgacgcagccacgggacgtggatcggacggcgcggaggtggacggaggagggatcaacggctgagatgcgttcctgcgtgccacgtggtgcgccgcgagcagataagggttcagggcgtcgcgacggggtcgagagataaggggcgcgcggcgagtggcgcgccacgtcgcgtggcccagattgcgttctccggattagagatttcgaaatatcttttcgcggagaaagaaaaaaaaattagacaaaaccaccctcggttgaggaaaaatatggggagtatttgtgcgtttttatttttgtttttgggtcgcactgttcgatcgtagcatccatgaccactgtggcatcgctgtctttgctgccgcacttgctcatcaagccttccttcaggtgttgctccagaaaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtcc

SEQ ID NO: 13 - DNA, 5302 bp, Artificial
  synthetic
  misc_feature (1)..(5302): repair donor template
  misc_feature (1)..(1000): upstream homology arm
  misc_feature (1001)..(1244): CaMV 35S terminator
  misc_feature (1245)..(2277): hygromycin resistance gene
  misc_feature (2310)..(4302): ZmUbi promoter
  misc_feature (4303)..(5302): downstream homology arm
  misc_feature (4321)..(4324): mutated PAM site
tccgtttcacaatgtaagtcattttagtatttttcatattcatattaatgttaatgaatctaaatatatatatatatatgtctagattcattaacattaatatgaatgtgggaaatgcgaatgacttacattttaaaacggagggagtaccgccaaacgtaatattaccaggttggaggaccgatctgaaaaatattccgtgcaagtacacattggacgtggaccgcattgcatacaagtacaagagttgaaacgcttggttctcgaggctgccacgtcagagcttgagccttcgaagcgatcccacgtggcagcacgtggaaggctcgtggagatcgcgggcagctccccgcctcttatcgacagggccacctcgcccgcgaaaattattatttttttcgccttcctttaataatacgcacgtatttatacgatcttacttaagcgagcaccattagcatgccacgtgtcaccgtaacaatctacgtagaccccgcaagtatttgtattcactaaactttcgtaaacgaaacttgcaaaacacatcaaaccggtcaaatttggacagaaaattcagccgagatcgcaaatattcgtttcaaaacaaattactgtaaccggcgacgcagccacgggacgtggatcggacggcgcggaggtggacggaggagggatcaacggctgagatgcgttcctgcgtgccacgtggtgcgccgcgagcagataagggttcagggcgtcgcgacggggtcgagagataaggggcgcgcggcgagtggcgcgccacgtcgcgtggcccagattgcgttctccggattagagatttcgaaatatcttttcgcggagaaagaaaaaaaaattagacaaaaccaccctcggttgaggaaaaatatggggagtatttgtgcgtttttatttttgtttttgggtcgcactgttcgatcgtagcatccatgaccactgtggcatcgctgtctttgctgccgcacttgctcatcaaagctgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatcccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgaacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccgggaagcttatcgtctacctgcagaagtaacaccaaacaacagggtgagcatcgacaaaagaaacagtaccaagcaaataaatagcgtatgaaggcagggctaaaaaaatccacatatagctgctgcatatgccatcatccaagtatatcaagatcaaaataattataaaacatacttgtttattataatagataggtactcaaggttagagcatatgaatagatgctgcatatgccatcatgtatatgcatcagtaaaacccacatcaacatgtatacctatcctagatcgatatttccatccatcttaaactcgtaactatgaagatgtatgacacacacatacagttccaaaattaataaatacaccaggtagtttgaaacagtattctactccgatctagaacgaatgaacgaccgcccaaccacaccacatcatcacaaccaagcgaacaaaaagcatctctgtatatgcatcagtaaaacccgcatcaacatgtatacctatcctagatcgatatttccatccatcatcttcaattcgtaactatgaatatgtatggcacacacatacagatccaaaattaataaatccaccaggtagtttgaaacagaattctactccgatctagaacgaccgcccaaccagaccacatcatcacaaccaagacaaaaaaaagcatgaaaagatgacccgacaaacaagtgcacggcatatattgaaataaaggaaaagggcaaaccaaaccctatgcaacgaaacaaaaaaaatcatgaaatcgatcccgtctgcggaacggctagagccatcccaggattccccaaagagaaacactggcaagttagcaatcagaacgtgtctgacgtacaggtcgcatccgtgtacgaacgctagcagcacggatctaacacaaacacggatctaacacaaacatgaacagaagtagaactaccgggccctaaccatggaccggaacgccgatctagagaaggtagagagggggggggggggaggacgagcggcgtaccttgaagcggaggtgccgacgggtggatttgggggagatctggttgtgtgtgtgtgcgctccgaacaacacgaggttggggaaagagggtgtggagggggtgtctatttattacggcgggcgaggaagggaaagcgaaggagcggtgggaaaggaatcccccgtagctgccgtgccgtgagaggaggaggaggccgcctgccgtgccggctcacgtctgccgctccgccacgcaatttctggatgccgacagcggagcaagtccaacggtggagcggaactctcgagaggggtccagaggcagcgacagagatgccgtgccgtctgcttcgcttggcccgacgcgacgctgctggttcgctggttggtgtccgttagactcgtcgacggcgtttaacaggctggcattatctactcgaaacaagaaaaatgtttccttagtttttttaatttcttaaagggtatttgtttaatttttagtcactttattttattctattttatatctaaattattaaataaaaaaactaaaatagagttttagttttcttaatttagaggctaaaatagaataaaatagatgtactaaaaaaattagtctataaaaaccattaaccctaaaccctaaatggatgtactaataaaatggatgaagtattatataggtgaagctatttgcaaaaaaaaaggagaacacatgcacactaaaaagataaaactgtagagtcctgttgtcaaaatactcaattgtcctttagaccatgtctaactgttcatttatatgattctctaaaacactgatattattgtagtagtatagattatattattcgtagagtaaagtttaaatatatgtataaagatagataaactgcacttcaaacaagtgtgacaaaaaaaatatgtggtaattttttataacttagacatgcaatgctcattatctctagagaggggcacgaccgggtcacgctgcactgcagaagcttgctgccttcaggtgttgctccaggcaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcct

SEQ ID NO: 14 - DNA, 143 bp, Artificial
  synthetic
  misc_feature (1)..(143): sequence at rice CAO1 locus resulting from ADurb.160Csm1-mediated edit
  misc_feature (1)..(20): from upstream homology arm
  misc_feature (21)..(109): partial insertion of CaMV 35S terminator
  misc_feature (110)..(143): from downstream homology arm
ctgccgcacttgctcatcaaagctgaattaacgccgaattaattcgggggatctggattttagtactggattttggttttaggaattagaaattttattgatagaagtacagtgcaatggagttaccatttttgttcttctga

SEQ ID NO: 15 - DNA, 43 bp, Artificial
  synthetic
  misc_feature (1)..(43): OsCAO1-targeting gRNA
  misc_feature (1)..(19): Csm1-interacting scaffold
  misc_feature (20)..(43): CAO1-targeting sequence
aatttctactgttgtagattggagcaacacctgaaggaaggct

SEQ ID NO: 16 - DNA, 3501 bp, Candidate Division CPR1 bacterium
  misc_feature (1)..(3501): ADurb.160Csm1 gene (plant codon optimized)
atggccccaaagaagaaacggaaggttatgcttaaaacgtttaagaatttttatgaagtcaggaagactgcgtcattcaaactgatccccaacaaaatttaccgccaaatcgaaatgtcgaaggaaccatccaactttaaagaccttggtaaacaatatgttaacataatcaactctttgtctgaactgttgtatgaagacgagcacgaagacaacacagaagaggtgggtctctccacaaacctcgggtctctgatctcccaagatgatcagttgaagatcggggagataacgaagagcgctaataagtcggtggaaaaccatgagcagataatactccatggtgacgagaaggattttgataagaaggactttaataaacttgtgaggatcaagcaccaatggataaaggaaaacttcaggtccgattggcataagaataaagaaaacatagtctcatataagaccaacaaagacgggaatcgcgttaagaccaaaaattggaccataataggtaatgtcgaatttttgcaagtcttcttcaaggactttctgaaaactgcgctcgagtacggtaacaacataattgagctcacggagtcacaggagcatgataagtctaggaactcagacatcaagttcctcctccagaaaatccagtcgaagctgcatcttaacaagatatatcaactcttcgaaggggagtatatcaaccacaaaaacgacaactctgatatcgagtaccttcgcgagcaactcagagacttcaagcagaaggcgaataattgtatcgagaattataaaataagcgactcgttcggcatgtttatcgagcacgggtcgctgaactactatactaggcggaagacacaaaaagactatgaggaagaaataatcaaaaagtctgaggggctgaagaacaagttttatggcaatctgggtgctctttacgggatagataaaaaccagcctattgaaaatctttacaaggaaatgaagatctttaaagcatcccagaagtctgcatttttgcaacgcctccaaagcgggattaacttcactaacttccaaaaggaatttaaattcatcgacaatagaggggatgttgttgaaaacttcaagatcgttctgttttccgacatcacagaggataggtacgaggaaatgcttaatcttacgaaccagatcgaaaaggaaaaaaacaaggaaagccgcaagcaacttaaggagaagcgcggcaaatactttcaacaccaccttaataaatataagaagttctgtaatgattacaaggatgttgccatggaattcgggaagcggaaggctgagataatcagcctccagagggaaaaggtcctggcggagcgggaaagaggatacgggttctttgccaaggatggtgaaaataatttttatataaatacctttgacatcgaaaactcacagcaagcctatcacgaactcataaacaacaagaacaccaagggggaaatcgcgtattatattcttagctcgattactcttcgcgcgcttgagaaactttgcttctccgaacgctcgaccttcagcaaaggtaacatcataaacaaactcgatgaaaagttcatcaaaattcagaatggatcgggccgcaaaatattcaaatcaaagaaggagttggaagaagagaacatccttattgactttttcgtcgaggtcctcaaacaccagacgaatctcaatttgaagttcaaatcgacacagtctatcaacattctgaaagagtgcaaagatataggcgcattcgaaattctcctgaagcaagaaacgtacatacttgatgagtattttatcagcaagcaaaactttgaaagcatactggaaaaatataaggggatttcttataagataacgtcaaaagatatcgaaaacaataccaataagtcaacattttcatcttggtggcgcgatttctgggaagaagagaataaggagaacgactacgtgttgcggatcaacccagagttttcgatttcgttcagacttggagacaaagaaaaatacaagaacactcttccgttccatcgcaaaaaaaataatcaatatttcttgaccatgagcttctcgcattctgccgacaggaattacattaacaccgcgttcatcaacgaggaggataggaagcagtccttgcaggatttcaacgacattttcaataggaagaataggttcgattatatctatggtatagataaggggactaaggaacttgtgactctgggtatatttaaaaaaagcaataagggactcgaaagcgtcaatatatcagaaaaaattcccgtttacaaaattaccaaagatggatttcttcacactaagacaactactaaaaagcaaccaaagaagggcgagcagcccattacgatacatactctggctaaaaatccctccctgtttttggacgaaatcgacaaccctaaaatattcgagaaactttccatcacttcttgtcttggggatctcacgtacgccaagctcatcaaggggaagattatacttaatgcagacatatccaccacgcttaatctgtacaaaaccaccgctaagaggtcactccataacgctgttacgaccggcaaaatgatttctaagcaagttctgtacgacaacgaagaaaatgttttctactacgaatacgagaaccggggcatcctcaacaaggaaaagaatctgtattggaaggatgagttcaactttctgcctcataaggacgagttcaattcactgaaggaagagatagagttcgagctcaacgaatatattaaagacatcaattcggaggaggacatctccatgcagaagatcaataactataaaaacgctgtctctgcaaacatagtgggcataattactgagctccagaagtactttgagggctatatttgctacgaaaccctcaacgagcaaacagtgaaaaaggagttcgataccttcataggcaatgtcattaacgagaaaatatacaataaactgcaacttaaccttgaggtcccccctatactcaaaaagttccgcacagaagttggaaacaaggacattatacaacacggaaagattctgtatgtgaacgagaaaaacacatcctcggcatgtcccgtgtgcaatgaacagctccttaagaaggataagaacgggaatctttcggataagaacgacaacgaaatcttcaagttggggggccacttgtccgactttgaaaacaacatgaaacaccttactgatttggaatatcaagaaaggctcaagaacaagtcttttgagaaggcaaatactaagaaggggaagatcgaaaagaataaatataactcaggtatcttgaacggcaaatcttgcgactaccacatgaagaagaataattacgggtttgactttatcgaatctggcgatgatctggcaacgtacaacatcgcgaaaaaggctaaggagtatctcgagagcctgcctactccgcctcagccctaa

SEQ ID NO: 17 - DNA, 3921 bp, Unknown
  Metagenome-Derived Sequence
  misc_feature (1)..(3921): AuxCsm1 gene (plant codon optimized)
atggccccaaagaagaaacggaaggttatgggcaagaacgagaataagtaccagttgtccaagacccttcggtttggtctcacactgaaggagaagatctcaaataatgaaaaaacgccttaccaaagccattcacagttcagggatctgatcatcctgagcgaaaatcgcatacgcgagggaatttcaactccccaaaaccgggacctgccatcattcattcatcgcatccagaattgcacggacttcatcaacgacttcatccatgactggtggatgattttgatgcacaccgggcagatcgagctcgacaaggattattacaagtcattgaccaagaaggtcggttttgttgggttctggtacaaagagaacaagaagaaaggtggcaagacgaaacagccacaagctcgcaatattcctatgggcgagctccgccatttgtgcccacagaacactaaggagtgcgcgacgtacattacagattattggaaagacttgctcatcacagcaacaaacaagctctacgagtcaagcgagcagcagaagaagtttatcaaagcgatggaacagaataggaccgacaataagcctaacgagatagatcttaaaaaatcttttctttcgttggtctctgtgaccatggagctccttaacccaatcctcaatggccagatcctttttaataagatggatcgccttgacatgtctaagaaatcggataacgacttcattgactttgttaatgatcacgagaccgtccgggagttgaacaatgatatcgaagaaattatagccgactttaaagagaatggtaacaacgtgaactactgcaaagcgaccttgaatccagacacggccttgaagcagcataacaacaatatcccgaacgacatcgcgaccgatttggaggaattgatgatggattcaatcgttggcaactatgacgatgtgaatagcttcatggataactacgtttcgaacttgtctgccaaggataagatcaaaaagattaaggactcaaacatctcgcttatctatcgcgccattctctttaagtacaagatgatcccggctaatgtcaggagagacatcgcacaggggatggctaagaagctcaataaggatgaggaaaatatatattcctttctgtgtgagtttgggaccctcaggacgcctcaaaaagactatgcggaccttaaggacaaggactctttcaatcttgacaactatcccttgaaagtggcttttgactttgcatgggaaggcctcgctaaggcttggtaccacgaccaaagcgatttcccgattgatccctgcagggatttcttgcaggagaacttcgacgtgaatctggaggaagatcaggaggatgagtattttctcctctatgcggatctcatagaacttaacgctttgctgtcgacattggataagggcaaccctgcggatcctgattcgattaaaaatgaggcccttgagatggtggagtacatcaattggaacagcctcgacaaaaagaacgggaactactacaagaagattatcaagaatagattgaaaagctcaaaaggcaacgagacctatgagaggatcaaaaaggagataagcatgtccaggggtaggctgaagaacaagattgagaagtacgatgacctcacctctcagtataaacggatcgccatggaccttggaaagaagttcgcgtccctgcgcgataagattattgccgcgaacgaggataataaggtgactcattacgcgatgatccttgaagactccaattgcgacaaatacctgctgcttcagaaagtttcaaacaacatataccattgcatgtcgtacgattcgtcggacccaaaggcctactacgttgactcaatcacctcttcggccattgccaagatgatacgcaaggagacgaatcctagcaagattcgggagtacgccgagttggaagaaaaagaaagggagagacgcaacgttgatgattggtgccgcttcatttcgaaaaaggagtacgatcggagataccaactgaacattaacaatggcctcagctttgaagcgctcaaaaaagagatcgattctaagtcgtacatactcgtgaagaagaacatctccgtcgattccatccgggagcttgtcgaaaatgaaggatgcttgctttttccgattgtcaataaagatcttacaaaagagaggaaaaccacagaggataaccaattcaccaaagactggaacatgatctttagcggttctgaaacgaattggagactgacgcccgagtttagagttacatatagaaacccggtcccgggatatccgaatgacaagtttggatccaagagatatagccgcttccagatgaacgcgcatttcgtttgcgacttcatcccgagctcaaattcctacacttctaaccgggaacaaattgccatcttcaaggatgaaggagagcaaaagaagagggtggaggaattcaatcggaccctcagcaacattaaccagaagttctatgttatcggaatcgatagaggccaaaaggaactcgcaaccctgtgtgttgtggaccaggataagaaaatccatggcgattttaagatttatacgagaaagttcaacagcgaacggaaacagtgggaacattactcgttggaaggagaaaagggcactagaaatatactggatctctctaatttgcgcgtggagaccactataattatcgatggcaagccagagcggcggcaggtgcttgtggatctcagcgaggttctcgttaaggataaggagggcaattacaccaaaccgaataaaatgcaaatcaagatgcaacagatggcgtacgtgcgcaagttgcagtttcaaatgcaagcgaatcccacggaggttctggagtggtatgagcagaaccctacggaggagctcatcattaagaacctggttgacaaggagaacggggagaaaggactgatttcgttttatggaaccgcgctcgtggagctcgatcagactctgcctgtttctaagatcaaggaaatgttggaggagttcaaaatcctgaaacagagggagtccaagaaggagaacgtgcagaaggaactcaataatttgacccagcttgaagccgtggatagcctgaaggccggcatagtcgcaaacatggttggagtcatttcgtacatcctgaagacgctggattacaacgcgtatatttccttggaagatcttagcaccgttcagagctcgactgagttcgcttcgggcataagcggcgcaattacgaagatgtctagggaggaaggtagacgcattgatgtcgaaaagtatgctggactcggcctgtacaacttcttcgagatgcagctgctgcggaagctccaccggatccagacagataatggtaatattcttcatctggtgcctgccttccgcgcgcagaagaactacgaccacataatggttgggaaggagaagattaagaaccaatttggaatagttttttttgtcgatgcagccgccaccagcattaaatgcccgaggtgtggggcggtgaacgaggacaaattcaaccctgataagcaaaagtacccggacgctgagaagggaccaaagcttaggaacaggaaagaacagtcgggcaaaaaggtttgggtgacaagggacaaagaggatgacgatcgcatcaaatgctactgctgcgggttcgacacgaaggaaaagaacgagggcaacccctttatgtacataaagtcgggcgatgacaacgctgcgtatctcatctctgacctgggggtggagtcttaccgcaaggcgtacgagttggccgctacggttgtcgaagatcgcaaaaagactttgacgaataatctcaaccaatcgaactataagattcgcttcctttggcatacaatgtactag

SEQ ID NO: 18 - DNA, 3915 bp, Unknown
  Metagenome-Derived Sequence
  misc_feature (1)..(3915): LAHSCsm1 gene (plant codon optimized)
atggccccaaagaagaaacggaaggttatgaagaatatagtgaataactatcaaatctcaaagacccttcgcttcggactgacgcagaagactaagattcagaaggagggatataacggtgagatatacgtttcacaccgcgagctcgccgatctcgtcaaaatttccgaggaaagaatcaaaaaatctgtttccagctctgacaagtccaatcttgaactctcgctggataagattgacatctgcctcaaacaggtcggggcgtttctgtctgattggcagcaggtctactatagaaaggaccaggttgctctggataaggattattataagattctgtgcaaaaaaattgagtttgacggattctggaaggacgtcaagggtcaaagaatgccgaatagccgcattataaacatctcggagctcgacactaaggatagcctcggtgttgagcggcttcaatacgttctgaattattggaaggataatctcgtctcagcaagccagaagtactcagtcgtggaggagaagataaaaaggtttaagctcgcaattaagataaataggacggacaataagccggatgaagtggagcttaggaaaatgttcctttcactggccaacatcgtttgtgataccctgcagccgctgtgctatggtcaaatctcctttcccaagattaacaaactggacgacagccgggctgataataaaaagttgatcaagttcgcgaccgattataaatcgaagaatgatttgcttacttccatagccgagcagaagaagtacttcgaggaaaacggcggtaacgtgccgttctgccgcgcgacgctgaaccctaaaacagcactgaaggacccgaactccactgataattcgatcaagggcgagataacccagttgggcctcgactccatattgaaaagcttcaaatcctacctgttcttcgaaaattcactggagcacatgtcggcgaaggaaaagattgatttgatgaagtcgtctggcgccaatgtggtcaaaaaggggttgatgtttaaatataagcccatacccgtcattgtgcatcgcgaagtggcccacgagctcagcaaggacttgaacaagacggaggaaagcctctctgacttcctccgggggatcggccaggccaaatcgcctgccaaagattatgaggagctgactgataagaacaagttcaatattgaagcataccccattaaggtcgccttcgactttgcatgggagtcattggcgaaggctaaataccactctgaaattgacctccctgttgccgcttgcgaaaaattcctcaacactttctttgacgtgaagccgaacaatgataaatttctgctctacgctaagttgcaggagctgaatgcgcttattagcacactcgagtacggcaatccatctgatgagcagtcaatcgtcgaaaaaattaaagctctttcaaatgaaattaagtggggcgactttggagggagcgggcagggatataagaaatctatttccgactgggcagactctaagaaggattccgacggctttaagatcgcgaagcaaaaaattgggctgttccgcgggggcctcaggaacgaaatagccgagtattataacttgacgcaaatatataagaagaccgttatgcaggaaggtaagctcttcgcgaccatgcgcgataagattacaggagcagcagaacaaaacaaggtgacgcactacgctgctatcatcgaagacaaaacgggcgacaagtacgtccttctgcaggaggtgcctcttaataagcaggatcggatatacgataaaatggatagaaacggggacggctacgtgtcctacttcgtgaactccataacctcaagaacgatcgcaaagcagctccggaaaaagaggatggcggagcttatgaagaacaatgctcgcggtatctacaacaacgtctcgaacattcagcagcctgctttgagcgataaggagaaggaggagagaaacatcaaagagtggatctctttcatttctgagaagagatgggattatgagttcaacctgaacttcaagggcaaaaactttgaagagattaagaaggaagtggatgccaatggctatgagcttgaaaacagaatcctctcgcgggatgcactggaggaactcgtcaagaacaaaaagtgcttgcttctcccgatcgtgaaccaagacatcattaaagagtctaagaccgagtcgaaccagttcacaaaagactggaacagcattttcgacggcaactcaccttggagactgacgccggaattccgcgtgtcgtaccgcaagcccacgccagactatcctatgtcagataagggcgataaacgctactcacgcttccaaatgattgcccatttcctctgtgattatatcccccaaggaggctcatacgtttcagtccgcgagcaaatcgacaattataaggacgataagaagcaggagattgcagtcaaggatttccacgacagacttctcggcaaaaccgacgagcaaaaattcattgagggcctgggtggcctgtccagccttggcaatgtcactatcaaaaccaaacttaaaaaacaggacatttccaaggaaaagttctatgtcttcggaatagatcgcggtcagaacgaactcgcgacactctgtgtgattgaccaggacaagaagattcaaggaggcttccgcatctatacgaggctttttaacaatgagaagaagcaatgggagcacaaatttctcgaagagcgcaatatcctggatctctctaatcttcgcgtggaaaccaccatagttatagatggccaagagaagagggaaaaggtgcttgtggacctctcggaggttaaggtcaaggacaacagcggcaactacgttaaaccgaacaaaacgcaaatcaaattgcagcagttggcatacatcaggaaactccagttccaaatgcagactaacccaggacgcgtcctggagtggtactcacataaccagacgtctgacctcattatcgacaatttcgtcgacaaacagaatggcgaggagggcctggttccgtttttcggagcagccgttgccgagcttaaggacacgctccccattgataggatttcagacatgctcaagcaattcgtcgagttgaaaaatttggagaagcagggcgaggatgtgaagtctaagatcgaccagctcatcgagcttgagccagcagataatctcaagtctggcgtggtcgccaacatggtcggtgttattgcgttcctcctcaagaaatattcttataaggtctatatctcgcttgaggatttgtccaagccatttaaggatcagattgtcctcggcatcagcggcgttcctattggcatcaaaaagggtatggcaggacgctctatcaatgtggagcagtatgctggtctgggcctctacaacttcttcgagatgcaactcttgaagaagctgtttcggatacagcaagattcttcccacatcctccatctggttcccgcattccgggctatgaagaattatgataacgtggcagtcggaaagggtaagatcaaaaatcaattcggcatcgttttcttcgtcgatgctgccgctacctctaagacatgcccatgctgcggggctattaatgatagacagttcgctccagacctcagaaagttcccaaatgcgaaaaagatcgaaaccccggatggcaagtccgtttggctcgaacgcgataaaacagacgggaaagacatcatcaggtgccatgtctgcggcttcgatacgtctaaggagtacgatgacaatcctcggaagtatatcaagtcaggggacgacaacgctgcataccttatctcggccgaatgcatcaaggcctatgaattggctactatactggttgacaataagtga

SEQ ID NO: 19 - DNA, 3681 bp, Smithella sp. M82
  misc_feature (1)..(3681): Sm82Csm1 gene (plant codon optimized)
atggccccaaagaagaaacggaaggttatggaaacaatcctctatcagaggaccaggtccattagattcaagctcgagcccattgaagcggaggagatagagaaggagatcaccgtcataaaaacccaggataatgacggtctcgtccaggattgtattttcctggtgaacaagggaaatgaactggccaacaaactctcaaagctcatctgtcgcgattataattgtgatgaacagaacaacatctctctcaagcttagaaaggatgtcgacgttaaatatgtgtggcttagactctacactaaaaatgagtactacgactggtcggagcccaacaataagaccaagatttattctttggctgaaattccttaccttagcgaaaagttcgtgcactggttcgcctcatggaagcgcgacctcgcgattcttaacgaacaaatcacgaagaaaaccgaggagcagcacaacctgaacaggcgggcagatatcgggctgatcatccaatctctctcgaagcggaactcattccctttcataaaggaattcatcgcggccatgaaccccaaaaacgcctccaagatcgagatcgaggagattgtcaaggaaattgatgagcttcttaacaagtgcgagaagggattcctcccaacgcaaagctctggctacccgatcgcgagagcgtccctgaattactatacgatttttaagaacccaaaggattttgataaggagatcctcgagcttagcggggaaaaattttgtaacgacaaccaaaacgagtgtgaaattctgaaggcattcttcacccactgcttcgacgtggacggcttttgcggtatgtttttggatgtgaaaaagctcgagaatatctgctccaagttgaactcaattaaaaattaccaagagaatgataagcaactgatcgcggaagccatcgataataaaataaagctgttgaatgaggaaaaggataactctaagaaaaagaaggccaagaaaatcatagagcagctcgaaaatgacaaaaagatcgtctgcaatttttgggagctccaagagaacttctatgtgcaggagcggaactcttcgaagaacaacaacaacaagtattgccttaacaagaactacttcctgatacagcaactgtgccaatccatgaagctgttcaaagccagggaaaaggcaaggtttaacgaagccgtgcaaaataataaggatctcccctatggccagctcaaccaattctttcttttttcggccatccagatcggaaacgagaatgataagaggaagactgataatgaagtcttcgacgacttcatgaagcataacaaggagttgcacgacatttcagacaaaatttccaccctcaaacagaataagaatctcgatgagaagaacaagaaggagctcgataagatttgtactcaaaaggaccaaatcgctaagtctaggggcaagtacttcaccgacttggaccataataaaacttacttctcaaattatgtcaagttctgcaacgtctaccgcgaggtggctctgaaggcgggacagctcaaggcgagaataaaagggatagagaaagagaagatcgaatcccagcggttgaaatattggtcagtgattatagaggagaacaagaaacaatacgttgctttcatacctaagtcgaacgattacgcaaagaaagcatacgaaaactattcgaaaatctacactaacgataattccattaatacttgtcagctccattactttgagtcactcacgcacagggccctcgagaagctgtgcttcagcggtgtccaggagaggactaacaccttccaacccgagattaagaaggaactttctatcgagaagttccccaactattacgagaagggctacttcatcaagggcgaatacttctttaatgacaaaaaaacagggatcaaggacgagtcgaaactcatccaattttacaaggatgtcctcaacacccagtatgccaagtcggccttgaagggaatcccgtgggagcagctgaaaaagacggtccttgacattcagttcgaaaattttgacggatttcgccaggctttggagaagttcagctacgtgaagcatattaagacgaaaaaagacctcctgaacgagctctcgaaggaatatgacgcgcagatcttcgagattacttctttggatctcaaaaggcaaataaaagaggacgccaatctcaaagaacacacaaagatctggatggaattttggtctgaaaacaaccagtcgaataactatcttattcggatcaatccacagctcactattacctggagagactcgaaagagagcagggagaaaaagtatggtgaggaaacctcgctttacgacgtcaacaagaacaatcggttcctcaagccacagtatacgatttctttcaccatcacggagaatgctacgactcaaactatgaatacagcttttaaagatgcgcaaacaaagaaggatcaaattcacgagttcaacaagcagctcttccagtcataccagccacagtatttttttggcatagatgttggaaacattgagttggcaactctttgtattatcaatcccgagaaagatctgaatgaggagaagatgtccaaagaatccctccagtattttgacgtgtacaagttgaagaaggatcagtacaacttttcaaagccttaccatttcaagacacggaatgagactagggagagaaaggcgatcgacaaccttagctacttcgcaatagaggagaattataagcaaacctttaacgatgataacttcgaagcatgtttttccgacctgttcgagaagcctgtgaacacatgcgccattgaccttacaactgcaaaagtgctgggtgataagatcttcctcaatggggacataaagacatacctttccctcaaggagcggaatgctagaaggaagatctgccagattatagagaagcaccccaacgcgaaactgcttatcaacggcaacaagattttctttcaggagtctacatcttgtgagagaacctgcctgtgtcaggaacctatttactacttcaatgataaatatgaccgggaagttcagactctggcagacattaataacagattggaggactacattaaggacaaggacaagtcagagttgatcgaagagtctaagataaaccatctgcgggctgcaatagcagctaatatgaccggcgtgatctaccacctttttgagaaataccagagccttatcgtgcttgagtatctcaccatctctgacattgctagccacaagaagggcctgaaagccttcgagggcaacattacacggcctcttcagattgcgttgttcaggaagttcctcaagtcctcacttgtgccacccgcactctcagagattattcaactgagggaaaaggcgaaggaccgcattaccaagattggtataatcaattttatcgacaagactgcaacctcggtgtcgtgcccaaactgtctcgggaagtttgagaactacaatgataataaacgcaaagggttctgcctttgcccagactgtggtttcgacaccagaaccgacctgaagggtttcgaaggtctcgacggacctgacaaagtggccgcgtttaacattgctaaacggggcttcgaagacctgcaaaaacacaagtaa

SEQ ID NO: 20 - protein, 1206 aa, Candidate Division CPR1 bacterium
  MISC_FEATURE (1)..(1206): ADurb.160Csm1 protein
MTHNPTILRKTLPLYKEVHFIWRGHAEITSLSLQIYLCLNMAPKKKRKVMLKTFKNFYEVRKTASFKLIPNKIYRQIEMSKEPSNFKDLGKQYVNIINSLSELLYEDEHEDNTEEVGLSTNLGSLISQDDQLKIGEITKSANKSVENHEQIILHGDEKDFDKKDFNKLVRIKHQWIKENFRSDWHKNKENIVSYKTNKDGNRVKTKNWTIIGNVEFLQVFFKDFLKTALEYGNNIIELTESQEHDKSRNSDIKFLLQKIQSKLHLNKIYQLFEGEYINHKNDNSDIEYLREQLRDFKQKANNCIENYKISDSFGMFIEHGSLNYYTRRKTQKDYEEEIIKKSEGLKNKFYGNLGALYGIDKNQPIENLYKEMKIFKASQKSAFLQRLQSGINFTNFQKEFKFIDNRGDVVENFKIVLFSDITEDRYEEMLNLTNQIEKEKNKESRKQLKEKRGKYFQHHLNKYKKFCNDYKDVAMEFGKRKAEIISLQREKVLAERERGYGFFAKDGENNFYINTFDIENSQQAYHELINNKNTKGEIAYYILSSITLRALEKLCFSERSTFSKGNIINKLDEKFIKIQNGSGRKIFKSKKELEEENILIDFFVEVLKHQTNLNLKFKSTQSINILKECKDIGAFEILLKQETYILDEYFISKQNFESILEKYKGISYKITSKDIENNTNKSTFSSWWRDFWEEENKENDYVLRINPEFSISFRLGDKEKYKNTLPFHRKKNNQYFLTMSFSHSADRNYINTAFINEEDRKQSLQDFNDIFNRKNRFDYIYGIDKGTKELVTLGIFKKSNKGLESVNISEKIPVYKITKDGFLHTKTTTKKQPKKGEQPITIHTLAKNPSLFLDEIDNPKIFEKLSITSCLGDLTYAKLIKGKIILNADISTTLNLYKTTAKRSLHNAVTTGKMISKQVLYDNEENVFYYEYENRGILNKEKNLYWKDEFNFLPHKDEFNSLKEEIEFELNEYIKDINSEEDISMQKINNYKNAVSANIVGIITELQKYFEGYICYETLNEQTVKKEFDTFIGNVINEKIYNKLQLNLEVPPILKKFRTEVGNKDIIQHGKILYVNEKNTSSACPVCNEQLLKKDKNGNLSDKNDNEIFKLGGHLSDFENNMKHLTDLEYQERLKNKSFEKANTKKGKIEKNKYNSGILNGKSCDYHMKKNNYGFDFIESGDDLATYNIAKKAKEYLESLPTPPQP

SEQ ID NO: 21 - protein, 1346 aa, Unknown
  Metagenome-Derived Sequence
  MISC_FEATURE (1)..(1346): AuxCsm1 protein
MTHNPTILRKTLPLYKEVHFIWRGHAEITSLSLQIYLCLNMAPKKKRKVMGKNENKYQLSKTLRFGLTLKEKISNNEKTPYQSHSQFRDLIILSENRIREGISTPQNRDLPSFIHRIQNCTDFINDFIHDWWMILMHTGQIELDKDYYKSLTKKVGFVGFWYKENKKKGGKTKQPQARNIPMGELRHLCPQNTKECATYITDYWKDLLITATNKLYESSEQQKKFIKAMEQNRTDNKPNEIDLKKSFLSLVSVTMELLNPILNGQILFNKMDRLDMSKKSDNDFIDFVNDHETVRELNNDIEEIIADFKENGNNVNYCKATLNPDTALKQHNNNIPNDIATDLEELMMDSIVGNYDDVNSFMDNYVSNLSAKDKIKKIKDSNISLIYRAILFKYKMIPANVRRDIAQGMAKKLNKDEENIYSFLCEFGTLRTPQKDYADLKDKDSFNLDNYPLKVAFDFAWEGLAKAWYHDQSDFPIDPCRDFLQENFDVNLEEDQEDEYFLLYADLIELNALLSTLDKGNPADPDSIKNEALEMVEYINWNSLDKKNGNYYKKIIKNRLKSSKGNETYERIKKEISMSRGRLKNKIEKYDDLTSQYKRIAMDLGKKFASLRDKIIAANEDNKVTHYAMILEDSNCDKYLLLQKVSNNIYHCMSYDSSDPKAYYVDSITSSAIAKMIRKETNPSKIREYAELEEKERERRNVDDWCRFISKKEYDRRYQLNINNGLSFEALKKEIDSKSYILVKKNISVDSIRELVENEGCLLFPIVNKDLTKERKTTEDNQFTKDWNMIFSGSETNWRLTPEFRVTYRNPVPGYPNDKFGSKRYSRFQMNAHFVCDFIPSSNSYTSNREQIAIFKDEGEQKKRVEEFNRTLSNINQKFYVIGIDRGQKELATLCVVDQDKKIHGDFKIYTRKFNSERKQWEHYSLEGEKGTRNILDLSNLRVETTIIIDGKPERRQVLVDLSEVLVKDKEGNYTKPNKMQIKMQQMAYVRKLQFQMQANPTEVLEWYEQNPTEELIIKNLVDKENGEKGLISFYGTALVELDQTLPVSKIKEMLEEFKILKQRESKKENVQKELNNLTQLEAVDSLKAGIVANMVGVISYILKTLDYNAYISLEDLSTVQSSTEFASGISGAITKMSREEGRRIDVEKYAGLGLYNFFEMQLLRKLHRIQTDNGNILHLVPAFRAQKNYDHIMVGKEKIKNQFGIVFFVDAAATSIKCPRCGAVNEDKFNPDKQKYPDAEKGPKLRNRKEQSGKKVWVTRDKEDDDRIKCYCCGFDTKEKNEGNPFMYIKSGDDNAAYLISDLGVESYRKAYELAATVVEDRKKTLTNNLNQSNYKIRFLWHTMY

SEQ ID NO: 22 - protein, 1344 aa, Unknown
  Metagenome-Derived Sequence
  MISC_FEATURE (1)..(1344): LAHSCsm1 protein
MTHNPTILRKTLPLYKEVHFIWRGHAEITSLSLQIYLCLNMAPKKKRKVMKNIVNNYQISKTLRFGLTQKTKIQKEGYNGEIYVSHRELADLVKISEERIKKSVSSSDKSNLELSLDKIDICLKQVGAFLSDWQQVYYRKDQVALDKDYYKILCKKIEFDGFWKDVKGQRMPNSRIINISELDTKDSLGVERLQYVLNYWKDNLVSASQKYSVVEEKIKRFKLAIKINRTDNKPDEVELRKMFLSLANIVCDTLQPLCYGQISFPKINKLDDSRADNKKLIKFATDYKSKNDLLTSIAEQKKYFEENGGNVPFCRATLNPKTALKDPNSTDNSIKGEITQLGLDSILKSFKSYLFFENSLEHMSAKEKIDLMKSSGANVVKKGLMFKYKPIPVIVHREVAHELSKDLNKTEESLSDFLRGIGQAKSPAKDYEELTDKNKFNIEAYPIKVAFDFAWESLAKAKYHSEIDLPVAACEKFLNTFFDVKPNNDKFLLYAKLQELNALISTLEYGNPSDEQSIVEKIKALSNEIKWGDFGGSGQGYKKSISDWADSKKDSDGFKIAKQKIGLFRGGLRNEIAEYYNLTQIYKKTVMQEGKLFATMRDKITGAAEQNKVTHYAAIIEDKTGDKYVLLQEVPLNKQDRIYDKMDRNGDGYVSYFVNSITSRTIAKQLRKKRMAELMKNNARGIYNNVSNIQQPALSDKEKEERNIKEWISFISEKRWDYEFNLNFKGKNFEEIKKEVDANGYELENRILSRDALEELVKNKKCLLLPIVNQDIIKESKTESNQFTKDWNSIFDGNSPWRLTPEFRVSYRKPTPDYPMSDKGDKRYSRFQMIAHFLCDYIPQGGSYVSVREQIDNYKDDKKQEIAVKDFHDRLLGKTDEQKFIEGLGGLSSLGNVTIKTKLKKQDISKEKFYVFGIDRGQNELATLCVIDQDKKIQGGFRIYTRLFNNEKKQWEHKFLEERNILDLSNLRVETTIVIDGQEKREKVLVDLSEVKVKDNSGNYVKPNKTQIKLQQLAYIRKLQFQMQTNPGRVLEWYSHNQTSDLIIDNFVDKQNGEEGLVPFFGAAVAELKDTLPIDRISDMLKQFVELKNLEKQGEDVKSKIDQLIELEPADNLKSGVVANMVGVIAFLLKKYSYKVYISLEDLSKPFKDQIVLGISGVPIGIKKGMAGRSINVEQYAGLGLYNFFEMQLLKKLFRIQQDSSHILHLVPAFRAMKNYDNVAVGKGKIKNQFGIVFFVDAAATSKTCPCCGAINDRQFAPDLRKFPNAKKIETPDGKSVWLERDKTDGKDIIRCHVCGFDTSKEYDDNPRKYIKSGDDNAAYLISAECIKAYELATILVDNK

SEQ ID NO: 23 - protein, 1266 aa, Smithella sp. M82
  MISC_FEATURE (1)..(1266): Sm82Csm1 protein
MTHNPTILRKTLPLYKEVHFIWRGHAEITSLSLQIYLCLNMAPKKKRKVMETILYQRTRSIRFKLEPIEAEEIEKEITVIKTQDNDGLVQDCIFLVNKGNELANKLSKLICRDYNCDEQNNISLKLRKDVDVKYVWLRLYTKNEYYDWSEPNNKTKIYSLAEIPYLSEKFVHWFASWKRDLAILNEQITKKTEEQHNLNRRADIGLIIQSLSKRNSFPFIKEFIAAMNPKNASKIEIEEIVKEIDELLNKCEKGFLPTQSSGYPIARASLNYYTIFKNPKDFDKEILELSGEKFCNDNQNECEILKAFFTHCFDVDGFCGMFLDVKKLENICSKLNSIKNYQENDKQLIAEAIDNKIKLLNEEKDNSKKKKAKKIIEQLENDKKIVCNFWELQENFYVQERNSSKNNNNKYCLNKNYFLIQQLCQSMKLFKAREKARFNEAVQNNKDLPYGQLNQFFLFSAIQIGNENDKRKTDNEVFDDFMKHNKELHDISDKISTLKQNKNLDEKNKKELDKICTQKDQIAKSRGKYFTDLDHNKTYFSNYVKFCNVYREVALKAGQLKARIKGIEKEKIESQRLKYWSVIIEENKKQYVAFIPKSNDYAKKAYENYSKIYTNDNSINTCQLHYFESLTHRALEKLCFSGVQERTNTFQPEIKKELSIEKFPNYYEKGYFIKGEYFFNDKKTGIKDESKLIQFYKDVLNTQYAKSALKGIPWEQLKKTVLDIQFENFDGFRQALEKFSYVKHIKTKKDLLNELSKEYDAQIFEITSLDLKRQIKEDANLKEHTKIWMEFWSENNQSNNYLIRINPQLTITWRDSKESREKKYGEETSLYDVNKNNRFLKPQYTISFTITENATTQTMNTAFKDAQTKKDQIHEFNKQLFQSYQPQYFFGIDVGNIELATLCIINPEKDLNEEKMSKESLQYFDVYKLKKDQYNFSKPYHFKTRNETRERKAIDNLSYFAIEENYKQTFNDDNFEACFSDLFEKPVNTCAIDLTTAKVLGDKIFLNGDIKTYLSLKERNARRKICQIIEKHPNAKLLINGNKIFFQESTSCERTCLCQEPIYYFNDKYDREVQTLADINNRLEDYIKDKDKSELIEESKINHLRAAIAANMTGVIYHLFEKYQSLIVLEYLTISDIASHKKGLKAFEGNITRPLQIALFRKFLKSSLVPPALSEIIQLREKAKDRITKIGIINFIDKTATSVSCPNCLGKFENYNDNKRKGFCLCPDCGFDTRTDLKGFEGLDGPDKVAAFNIAKRGFEDLQKHK

SEQ ID NO: 24 - DNA, 3474 bp, Candidate Division CPR1 bacterium
  misc_feature (1)..(3474): ADurb.160Csm1 gene (native sequence)
atgttaaaaacttttaaaaacttttatgaggtaaggaaaacagctagtttcaagctaattcctaataaaatttatagacaaattgaaatgagtaaagaaccttcaaattttaaagatctgggaaaacaatatgttaatataataaattctttatcagagttattatatgaagatgaacatgaagacaatactgaagaagtatgattgtctacaaacttatgatcacttatatcccaagatgaccaattaaaaattggagaaataacaaaatctgcaaacaaatctgtcgaaaatcacgagcaaataattttacattgagatgaaaaggattttgataaaaaggattttaataagcttgttagaataaaacatcaatggattaaagagaactttagaagtgattggcataaaaataaagaaaacattgtttcttacaaaaccaataaagattgaaacagagttaaaacaaaaaattggactattatttgaaatgtggagtttttacaagttttttttaaagactttttaaaaacagcactagaatattgaaataatattatagagttaaccgaatcacaagaacacgataaaagtagaaatagtgatataaaatttttactacaaaaaattcaatctaagttacacttaaataaaatttatcaattatttgaatgagaatatataaatcataaaaatgataattcagatatcgaatatttaagagagcaacttagagactttaaacaaaaagctaacaattgtatagaaaactataaaattagtgattcgttttgaatgtttatagaacacggaagtcttaattattatacaagaagaaaaacacaaaaagattatgaagaagaaattattaaaaaatcggaatgattaaaaaacaaattttatggaaatttatgagcactttattgaattgataaaaatcaacctatagaaaatctttataaagaaatgaagatttttaaagcaagtcaaaaaagtgcttttttgcagagattacaaagtggtattaattttactaattttcagaaggaatttaaatttattgataatagatgagatgttgttgaaaactttaaaatagttttgttctctgacataacggaagataggtatgaagaaatgttaaatttaaccaatcaaattgaaaaagaaaaaaataaagaatctagaaaacaattaaaagaaaaaagaggaaaatattttcaacatcatcttaacaaatacaaaaaattctgtaatgattataaagatgtggcaatggagttttgaaaaaggaaagcggaaattatatcattacaaagagaaaaggtactcgcagaaagggaaagatgatactgattctttgccaaagattgagaaaacaatttctatataaacacatttgatatagaaaactcacaacaagcttatcatgaactaattaacaataaaaatacaaagtgagaaattgcatattatattctaagctcgataactttgagagcattagaaaagctttgtttctcggaaagatcaacctttagtaaatgaaacataataaataagcttgatgaaaagtttataaaaattcaaaatggaagttgaagaaaaatctttaaaagcaagaaagaactagaagaggagaatatccttattgatttctttgtagaagtactaaaacaccaaactaatttgaacctaaaatttaaatctactcaatctataaacatactaaaagagtgtaaagatatcggtgcatttgagattttattaaaacaagaaacatatatattagatgaatattttatttcaaaacaaaattttgaaagtattttagaaaaatataagtgaatttcatataaaattacctcaaaagacattgagaataacactaataaaagtactttctctagttggtggagagatttttgggaagaagaaaataaagaaaatgattatgtattaagaataaatccagaattcagtatttcttttaggctttgagataaggaaaaatataaaaacacattaccatttcataggaaaaaaaataatcaatattttttaactatgagtttttctcattctgctgatagaaattatattaatactgcctttattaacgaagaagatagaaaacaatcattacaagattttaatgatatttttaatagaaagaatagatttgattatatttatggtatagataagggaacaaaagaattagtgaccttatgaatttttaaaaaatcaaacaaatgattggaatcagtgaatatttctgaaaaaattcctgtctacaaaatcacaaaagattgatttcttcatactaaaacaacgacaaaaaaacaacctaaaaaatgagaacaacctattacaatacacacattagctaaaaatccttccttgtttttagatgaaattgataatccaaaaatctttgaaaaattaagtattacttcttgtttatgagatttaacttatgcaaaacttataaaatgaaaaattattcttaatgcagatatttccaccacccttaatttatacaaaactacagcaaaaaggtctttgcataatgcagttacaacatgaaaaatgatatctaaacaagtattgtatgataatgaagaaaatgttttctattacgagtatgaaaatagaggcattttgaataaagaaaaaaatttgtattggaaagatgaatttaattttttgcctcacaaggatgaatttaattcattaaaagaagaaatagagtttgaattaaatgagtatataaaagatataaattctgaagaagacatatctatgcaaaaaataaataattacaaaaatgctgtctcagctaatattgtatgaatcattacagagttacaaaaatattttgagggatatatctgttatgaaaccttaaatgaacaaacagtcaaaaaggaatttgatacttttataggaaatgttataaacgaaaaaatctataataaattacaattaaatttggaagttccacctattttaaaaaagtttagaactgaagtctgaaataaagatattattcaacattgaaaaatattgtatgttaatgaaaaaaacacttcttctgcatgtcctgtatgtaatgagcaattattaaaaaaagataaaaattgaaatctatctgataagaacgataatgaaatttttaaattatgatgacatttaagtgattttgaaaataacatgaagcatttaacggatctagaatatcaagaacggttaaaaaataaaagttttgaaaaggctaatactaaaaaatgaaaaatagaaaaaaataagtataattcttgaattttaaattgaaaatcttgtgattatcatatgaagaaaaacaattatggatttgattttatagaatcttgagatgatctcgcaacatacaatatcgctaaaaaagccaaagaatatctagaaagtttacctactcctcctcaaccttaa

SEQ ID NO: 25 - DNA, 3894 bp, Unknown
  Metagenome-Derived Sequence
  misc_feature (1)..(3894): AuxCsm1 gene (native sequence)
atgggaaaaaatgaaaacaaataccagttatcaaaaacattacgttttggactaacactaaaagagaagatttcgaataatgagaaaacaccttaccaaagccattctcaattcagagatttaattatcctttcagaaaacagaatcagagaaggtatcagcactccccaaaaccgtgacttaccctcttttatccacagaattcaaaattgcaccgattttatcaatgatttcatccatgattggtggatgattctgatgcacacaggacaaattgaattggacaaagactactataaaagcctaactaaaaaagtgggatttgtaggtttctggtacaaagagaacaaaaaaaagggtggaaaaacgaagcaaccacaagccagaaacataccaatgggtgagcttagacatctttgtccccaaaatactaaggagtgtgccacatacatcaccgattattggaaagatcttttgataacagcaaccaacaaactgtatgaaagcagtgaacaacaaaagaaattcatcaaagcgatggagcagaatcgcacggataacaaacctaacgaaatagatctgaaaaaatcttttttgagtctggtatctgtgacaatggaactgctaaaccctattctaaacgggcagatactattcaacaaaatggacaggctcgatatgtctaaaaaaagcgacaatgatttcattgatttcgtcaatgatcacgaaacggttcgtgaattaaacaatgacattgaagaaataatcgctgatttcaaagaaaacggcaataatgtaaactattgcaaagcgacacttaatccagacacagcattaaagcaacacaacaacaatattccaaatgatatagcaactgatttggaagagctaatgatggacagcatcgtcggaaattatgatgatgtcaactcttttatggataattatgtttcaaatttatctgcaaaagataaaataaaaaaaatcaaagactccaatataagccttatttatcgcgctatcctcttcaaatacaagatgattccggcaaacgtaagaagagatatagcccaaggaatggccaaaaagctcaataaagacgaagagaatatctacagttttctatgcgagtttggcactttgcgtactccacaaaaagactacgctgatctgaaggacaaggacagtttcaatcttgacaactatccattgaaagtggcgtttgatttcgcatgggagggattagcaaaagcttggtatcacgaccaatctgattttcctattgatccatgtcgtgattttctacaagaaaattttgatgtgaacttagaggaagaccaagaagacgaatattttcttctgtatgcagatcttatcgagctaaacgccttattatcaactctcgacaaagggaatcctgcagaccccgactcaataaaaaatgaagcattggagatggtcgaatacataaattggaattcacttgacaaaaaaaatggaaactactacaaaaaaataatcaaaaaccgtctgaaatcttcgaagggcaacgaaacgtacgaaagaataaaaaaagagatttccatgagccgtggacgtcttaagaacaaaatagaaaaatatgacgatctcacttctcaatacaagcgtattgccatggatttaggaaagaaattcgcctctttacgagacaaaattatagctgcgaatgaggataacaaggtgactcactatgcaatgattcttgaggattccaattgcgacaaatatctcttgttgcaaaaagtaagcaataacatttatcattgtatgagttacgattcttcagatcccaaagcttactatgtcgactctatcacatcttctgcaatagcaaagatgatcagaaaggaaacgaatccatccaagataagagagtatgctgaattagaagagaaagaaagagagagacggaacgttgatgattggtgcaggtttataagcaaaaaagaatacgacaggaggtatcagttgaatattaacaatggtttatcttttgaggcactaaaaaaagagatcgattccaagagttatattttggtgaaaaagaacattagtgttgattctatccgtgaacttgttgaaaatgaaggatgccttcttttccctatcgtcaataaagacctcacaaaggaaaggaaaacaacagaagacaatcaattcacaaaagattggaatatgatattctctgggtctgaaaccaattggagattaacccctgaattcagagtgacgtatagaaatccagtaccaggatatcctaatgacaaatttgggtcgaaaagatattcaagattccagatgaacgctcattttgtatgcgattttattccatcctctaattcatacacatccaacagagagcaaatcgccatattcaaagacgagggagaacagaaaaagagagtagaggaatttaatcgcaccctatcaaacatcaatcaaaaattctatgtcattggtattgatagagggcaaaaagagcttgccacactttgtgtcgtcgaccaggataagaaaatacacggagattttaagatctacactcgcaaattcaattccgaaagaaagcaatgggagcattattctctcgaaggagaaaaagggacaagaaacatccttgatctatctaaccttcgtgttgagacgaccattataattgatggcaaaccagaaaggagacaagtgcttgtcgatctgagtgaggtgttggtgaaggataaagaaggaaattacacaaagcccaacaagatgcagatcaaaatgcaacaaatggcttatgttcgaaagcttcagttccaaatgcaggcaaatccaaccgaggttttggaatggtatgagcagaatccaacagaagagttgatcataaagaatctcgtcgacaaagagaacggagaaaagggacttatctctttctacggaacagcacttgtagaactagaccagacacttcccgtctcaaaaataaaagagatgctcgaggaatttaagatactgaagcaaagagaaagcaaaaaggagaatgtgcaaaaagagctgaataaccttacacaacttgaagctgtcgacagtctgaaagcaggaattgtcgcaaacatggttggtgtgatctcatatatcttaaagacactggattataatgcctatatctcactcgaagatttgtctacagtgcaatccagcaccgaatttgcaagtggaatatcaggagcaatcaccaaaatgtcgagagaagaaggaagaagaatagatgtggagaaatatgccggtcttggattgtataatttcttcgagatgcaattgctacgaaaactacaccgcatacaaacagacaacggaaacattcttcatcttgtccctgctttccgtgcccaaaagaattacgaccacatcatggtaggaaaagaaaaaataaagaaccaatttggaatcgtgttctttgtagacgcggcagctacatctatcaaatgcccacgctgtggagcggtcaatgaggataaattcaatccagataaacaaaagtacccagatgcagaaaaagggccaaaattgagaaatcgcaaggagcagtcaggcaaaaaagtatgggtaaccagagacaaggaagacgacgaccgtatcaaatgctattgctgtggattcgacacaaaggaaaagaacgaaggaaatccttttatgtatatcaagagtggcgacgacaatgcagcctatcttatatcagatttaggagttgagtcttacagaaaagcttatgaattagctgcgactgtagtggaagacagaaaaaaaacattaactaacaatttaaatcaaagcaactacaaaattagatttttatggcacactatgtattag

SEQ ID NO: 26 - DNA, 3888 bp, Unknown
  Metagenome-Derived Sequence
  misc_feature (1)..(3888): LAHSCsm1 gene (native sequence)
atgaaaaacattgtaaataactatcagatttcaaaaactttgcgttttgggttaacgcaaaaaacgaaaattcaaaaggaagggtataatggagaaatatatgtaagtcacagagaattggctgatttggttaaaatttcagaagaaagaattaaaaaaagtgtttcttctagtgataagtcaaatcttgagttatcactagataaaattgatatttgtcttaaacaagttggagctttcctatcggattggcagcaagtatattatagaaaagatcaagttgcattggacaaggattactataaaattctttgtaaaaagattgagtttgatggcttttggaaagatgtcaaaggtcaaagaatgcctaattcaaggataataaatatatctgaattagatacaaaggatagcttgggtgttgagagattgcaatatgtattgaattattggaaagacaatttggtcagcgcatctcaaaaatattcggtagtagaggagaaaataaaacgatttaagttggctattaaaataaacaggacagataataagcctgatgaagttgaacttagaaaaatgtttttatctctggcaaatattgtttgtgatacgctccaaccattgtgttatggccaaattagttttccaaaaataaataagttggacgattctagagctgataacaaaaaattaataaaatttgcgacagattataagtctaaaaatgacttgctcactagcattgctgagcaaaagaaatattttgaggaaaatggaggcaatgttccattttgccgggcgaccctaaatcccaagacagctttaaaggaccccaattcaacagataacagcattaaaggtgaaattactcagttaggactagattcaatattaaagagttttaaatcttatttattctttgaaaacagtttggagcatatgtcagcaaaagaaaaaattgatttaatgaagagtagtggagctaatgttgttaaaaaagggcttatgtttaagtacaaaccaattcctgtcatagtacacagagaagttgctcatgagttgagcaaagatttaaataaaaccgaggaatcattaagtgattttttgcgaggtattggacaagctaaaagtcctgcaaaggattatgaagagttgacagataaaaataaatttaatattgaggcatacccaataaaggttgcatttgattttgcttgggagagtttagcaaaggctaaatatcacagtgaaattgatttgccagtagctgcatgtgagaaattcttgaatactttttttgatgtgaaacctaataacgataaattcttgttatacgctaaacttcaagaacttaatgctcttatatctactttggagtatggaaacccttctgatgaacaatccattgtagaaaaaatcaaggctctgtctaatgaaataaaatggggcgattttggcgggagcgggcaggggtacaaaaaatcaatatctgattgggctgacagcaaaaaagattctgacggtttcaaaattgcaaaacaaaaaataggcctttttagagggggattaaggaatgaaatagctgagtattacaacttaacgcaaatatataaaaagactgtaatgcaagagggaaagctatttgcaactatgcgagataagataacaggtgcagccgaacagaataaagttactcattatgcggccattatagaggataaaacaggagataaatatgtgttgttacaagaggtgccattgaataagcaagacagaatttatgacaagatggaccgtaatggagatggatatgttagctattttgttaattctatcacgtcgcgcactattgctaaacaattaaggaaaaagagaatggcggaactaatgaagaataatgcgcgtgggatatataataatgttagtaatattcaacaaccggctctttccgataaagaaaaggaggaaaggaatataaaggaatggataagttttataagtgagaagagatgggattatgagtttaatttgaactttaaaggaaaaaactttgaggaaatcaagaaagaagtagatgctaatggctatgaattagaaaacagaatcttgagcagagacgctcttgaagagttagtaaaaaataagaaatgcttattgttgccaattgttaatcaggatattataaaggagagtaaaacggaaagcaatcaatttactaaagactggaattctatatttgacggtaattctccatggcgtttaactcctgaatttagagtgtcttaccgcaaacctactcctgattatcctatgtctgataaaggagacaagcgttactcgcgtttccaaatgattgcccattttttatgcgattacattcctcaaggtggtagttatgtatcagttagggaacaaatagataattataaggatgataaaaagcaagaaattgctgttaaggatttccatgataggttattgggaaaaactgatgaacaaaaatttatagaggggttaggtgggttgtcaagtttgggtaatgttaccataaaaactaaactcaaaaagcaagatatttctaaagagaaattttatgtttttggaattgacagaggacaaaatgaacttgcaacactttgtgtcattgatcaggataaaaaaatacagggcggtttcagaatatatacaagattatttaataatgagaaaaaacagtgggagcataaattcctggaagagcgcaatattttggatttatcaaatttacgtgtagaaaccactattgttattgatggacaggaaaaaagagagaaagtgttagtggatttaagtgaggtaaaggttaaagacaattcgggaaattatgtaaaacctaataagacacaaataaaactccaacagcttgcatatatccgcaaacttcaatttcaaatgcagacaaacccaggcagagttctagaatggtattctcataatcagaccagtgatttgattattgacaattttgtagataagcaaaacggagaggaaggacttgttccattttttggagctgcagtagcagaattaaaagatactttacctatcgataggatttccgatatgctaaaacagtttgtggaactaaagaacttggagaagcaaggggaagatgtgaagtcaaaaatcgaccagcttattgaacttgaaccagctgataatctaaagtctggtgtggttgcaaatatggttggtgtaattgcatttcttcttaaaaagtatagttataaggtctatatttcattagaagatttgtcaaagccatttaaagaccaaattgttttggggattagcggggtgccaattggtattaagaagggtatggcaggtagaagtattaatgttgaacaatatgcaggtcttggactttataatttttttgaaatgcaattgttaaagaaattattccggatacagcaggatagttctcatatcttgcaccttgtacctgcttttagggctatgaaaaattatgataatgtagcagtaggaaaagggaaaattaagaatcagtttggaatcgtattctttgtggatgctgctgcaacatcaaagacatgtccttgctgtggtgctattaacgatagacaatttgcacctgatttaagaaaattccctaatgctaaaaaaattgagaccccagatggaaagtctgtttggttggaaagggataaaactgacggtaaggatattataaggtgccacgtatgcggatttgatacttcaaaagagtacgatgacaatccacgtaaatacataaaaagtggtgatgataatgcagcttatttgatttctgctgagtgtattaaggcatacgaactagcaacaatactagttgataataaataa

SEQ ID NO: 27 - DNA, 3654 bp, Smithella sp. M82
  misc_feature (1)..(3654): Sm82Csm1 gene (native sequence)
atggaaacaatattataccaacgaacaagatcaatacggtttaaattagaacctattgaagcagaagaaatagaaaaagaaattactgtaatcaaaacccaagacaatgacggcttggtgcaagactgcatattcttggttaataaaggcaatgaacttgcaaataagctaagtaaacttatttgtcgtgattacaactgtgatgaacaaaacaatatctcattaaaacttagaaaagatgtggatgtaaagtatgtttggctgagactttatacaaaaaatgaatattatgattggagtgaacccaataacaaaacaaaaatatattcattagctgaaataccttatttatcagaaaaatttgtgcattggtttgcatcatggaaaagggatttggccatattaaatgaacaaataacaaaaaaaacagaggagcaacacaatttaaacagaagggcagatataggtttgattatacaatcattatccaagcgcaacagttttccctttataaaagagtttatagcagcaatgaatcctaaaaatgcatctaaaatagagatagaagaaatcgtaaaagaaattgatgagctgctgaataagtgcgaaaaaggatttttacccacccaatcatcgggttatccgattgctcgtgcaagtttgaattactatactattttcaagaatccaaaagattttgacaaggaaatattggaattaagcggtgaaaaattctgtaacgacaatcaaaatgaatgcgaaatattgaaagcattttttacgcattgttttgatgtggatgggttttgtggaatgttcttggatgtaaaaaaattagaaaacatctgctcaaagttaaatagcataaagaattatcaagaaaatgataagcaacttatcgcagaagccatagacaataaaattaagctactaaacgaagaaaaagacaatagcaaaaaaaagaaagcaaaaaaaataattgaacaacttgaaaatgataaaaaaatagtgtgcaacttttgggaacttcaggaaaacttttatgttcaagaaagaaattcttccaaaaataataacaataaatactgcctcaataaaaactattttttgatacaacagttatgccaaagcatgaaattattcaaggcaagagaaaaagcaaggtttaacgaagctgtacaaaataataaggacttaccttatggtcagttgaatcagttttttctgttttcagctatacaaatcggtaatgaaaatgacaaaagaaaaactgacaatgaggtgtttgatgattttatgaagcacaataaagagctacatgatatttccgataaaattagcacgcttaaacaaaacaaaaatttggatgaaaaaaataaaaaagaattagataaaatatgtacccagaaagatcaaatagcaaaaagcagaggcaaatattttacagatttagatcataataaaacctatttttccaattatgttaagttctgcaatgtatatagagaagttgctttaaaagctgggcagcttaaagccagaattaaaggcatagaaaaggaaaaaatagaatcccagcgattaaaatattggtcagtaattattgaagagaataaaaagcaatatgtcgcttttattcctaaaagtaatgactatgcaaaaaaagcttatgagaattattcaaaaatatatactaatgataattcaataaacacttgtcagttacattattttgaatcacttacacacagagctttagaaaaactttgtttcagcggtgtacaagaaagaacaaatacctttcaacctgaaataaaaaaggaattatcaatagagaaatttccaaactattacgaaaaaggatatttcattaaaggtgaatattttttcaatgataaaaaaacaggtataaaagatgaatccaaactaatccaattctataaagatgtactaaatacgcaatatgccaaatcagcgcttaaaggcatcccgtgggagcaattaaaaaaaactgttttagatattcagttcgaaaattttgatggattccgccaagctcttgaaaagttcagctatgtaaagcatattaaaacaaagaaagatttattgaatgaattatcaaaagaatatgatgctcaaatatttgaaattacctctttagatttaaaacggcaaatcaaagaggacgcaaatcttaaagaacacacaaaaatatggatggaattttggagcgaaaacaaccaaagtaataattacttgatcagaataaatccgcaattaaccatcacttggcgtgatagcaaagaaagcagagagaaaaaatatggagaagaaacttctttatatgatgtgaataaaaataaccgatttctaaaaccgcaatatacaatttcctttaccattaccgaaaacgccacaacacaaacaatgaacacagcatttaaagatgcgcaaactaaaaaagatcagattcatgagtttaataaacaattattccaatcatatcaacctcaatatttttttggaatagacgtaggaaatatagaattggccaccctgtgtattattaatcctgaaaaagatttgaatgaagaaaagatgtcaaaagaatctttacaatattttgatgtttataagttgaaaaaagaccaatataatttctctaagccctatcacttcaagacgaggaatgaaaccagggaaagaaaagcaatagataatctttcttattttgcaatcgaagaaaattacaaacaaacattcaatgacgataattttgaagcgtgtttttctgatttatttgaaaaaccggttaacacttgtgccattgatcttacaacggcaaaggttttaggtgataagatatttctcaatggcgatatcaaaacttatctttcgttaaaagaacgaaacgcaagaaggaaaatttgtcaaatcattgaaaaacatccgaacgctaaacttctgattaatggaaataaaattttctttcaggaaagtacatcatgtgaaagaacctgcctttgccaagaacctatttattattttaatgataaatatgatagagaagtacaaactttggcagatataaataatagacttgaagattatattaaagataaagataaatccgagctgatagaagagagtaaaataaatcacctcagagccgccattgctgcaaatatgactggcgttatctatcatctttttgaaaaataccagagcttaattgttttggaatatttaacgatttcagatatagcaagtcataaaaaaggcttaaaagcttttgaaggaaacataacacgtccattacaaattgcattatttcgtaaatttttaaaaagcagtcttgttccacctgcattgagtgaaattattcaattgagagaaaaagcaaaggatagaataacaaaaatagggataataaattttattgataaaactgctactagcgtttcttgtccaaattgtcttggtaaatttgaaaattataatgataataagagaaaaggattttgtttatgtcctgattgtggttttgatacaagaactgaccttaaaggatttgaaggcttagacggccccgacaaagttgccgctttcaatattgccaaaagaggatttgaagacttgcaaaagcacaaataa

SEQ ID NO: 28 - DNA, 2113 bp, Artificial
  synthetic
  misc_feature (1)..(2113): Experiment 187 Callus Piece #9 sequence data
  misc_feature (1)..(353): rice genomic sequence outside of repair piece
  misc_feature (354)..(1009): upstream arm (partial, includes 344bp deletion)
  misc_feature (1010)..(1113): ZmUbi promoter (partial insertion)
  misc_feature (1114)..(2113): downstream homology arm
  misc_feature (1132)..(1135): mutated PAM site
agtatgtattttatattaaaaatattgctatattttctataaatttaattagactggacaagtttgacatgaataaagtcaaagcgggttataaaatgaggaagtatcgtccattccctcgttaaaaaaagcaatttgtaactatagttatgaacgagtactggtcatgtctagattttatttatagccatttcgttttgggtcgagagcagagggaatatcttgcatgtaagtaaacatagagttaaatcaaagacatttgttcagttgtaccatattcaacatacctatagctttgaagctaccgaaattcttgtagcggacagcagcaagtgccgaaaaattctacttcatccgtttcacaatgtaagtcattttagtatttttcatattcatattaatgttaatgaatctaaatatatatatatatatgtctagattcattaacattaatatgaatgtgggaaatgcgaatgacttacattttaaaacggagggagtaccgccaaacgtaatattaccaggttggaggaccgatctgaaaaatattccgtgcaagtacacattggacgtggaccgcattgcatacaagtacaagagttgaaacgcttggttctcgaggctgccacgtcagagcttgagccttcgaagcgatcccacgtggcagcacgtggaaggctcgtggagatcgcgggcagctccccgcctcttatcgacagggccacctcgcccgcgaaaattattatttttttcgccttcctttaataatacgcacgtatttatacgatcttacttaagcgagcaccattagcatgccacgtgtcaccgtaacaatctacgtagaccccgcaagtatttgtattcactaaactttcgtaaacgaaacttgcaaaacacatcaaaccggtcaaatttggacagaaaattcagccgagatcgcaaatattcgtttcaaaacaaattactgtaaccggcgacgcagccacgggacgtggatcggacggcgcggtgacaaaaaaaatatgtggtaattttttataacttagacatgcaatgctcattatctctagagaggggcacgaccgggtcacgctgcactgcagaagcttgctgccttcaggtgttgctccaggcaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcct

SEQ ID NO: 29 - DNA, 2292 bp, Artificial
  synthetic
  misc_feature (1)..(2292): Experiment 188 Callus Piece #1 sequence data
  misc_feature (256)..(958): from upstream homology arm
  misc_feature (959)..(1927): from downstream homology arm
agtatgtattttatattaaaaatattgctatattttctataaatttaattagactggacaagtttgacatgaataaagtcaaagcgggttataaaatgaggaagtatcgtccattccctcgttaaaaaaagcaatttgtaactatagttatgaacgagtactggtcatgtctagattttatttatagccatttcgttttgggtcgagagcagagggaatatcttgcatgtaagtaaacatagagttaaatcaaagacatttgttcagttgtaccatattcaacatacctatagctttgaagctaccgaaattcttgtagcggacagcagcaagtgccgaaaaattctacttcatccgtttcacaatgtaagtcattttagtatttttcatattcatattaatgttaatgaatctaaatatatatatatatatgtctagattcattaacattaatatgaatgtgggaaatgcgaatgacttacattttaaaacggagggagtaccgccaaacgtaatattaccaggttggaggaccgatctgaaaaatattccgtgcaagtacacattggacgtggaccgcattgcatacaagtacaagagttgaaacgcttggttctcgaggctgccacgtcagagcttgagccttcgaagcgatcccacgtggcagcacgtggaaggctcgtggagatcgcgggcagctccccgcctcttatcgacagggccacctcgcccgcgaaaattattatttttttcgccttcctttaataatacgcacgtatttatacgatcttacttaagcgagcaccattagcatgccacgtgtcaccgtaacaatctacgtagaccccgcaagtatttgtattcactaaactttcgtaaacgaaacttgcaaaacacatcaaaccggtcaaatttggacagaaaattcagccgagatcgcaaatattcgtttcaaaacttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttgagcagtgcaatggagttaccatttttgttcttctgattggattctttgtgatggttgatgtttttgttcagacaatggtttcaaggttctgtgattcttcagaccccatatcttaaaacctgttgtattgaagtaagcaaaaaaacaaatcttgatcaaggacagcctagttgccaatttttctttgcaaatctgaatgcaattcaatctctttcttccagcaaatgcgtgcagctttcccccagtaaccacaggcttatctctgacactgatttaactagattttgctaatctctttgatactagtttgtctgctaaaatagagtgcatgtgaggttgatgaaaattgatggtgaccttgctgattgaaactacacagggtgttggtagatatggaggaatcaaggtgtatgcggtgctcggtgatgatggagctgactatgcaaagaacaacgcatgggaggccttgttccatgtcgatgacccggggccaagggttccaattgcaaaaggcaagttcttggatgtcaaccaagctcttgaggtggtccggttcgatatccagtattgcgattggagggcgcggcaggacctcctcaccatcatggttcttcacaacaaggtaggaagcattggacaagtcacaagttcagagaagaggtcaaagctttcatagtctgaattttacagatcatgggattcaaaattggactgcatactgaataatgcttgaggttgaagtttcggatgactgacataggttaacttaaatgaatttttgaacattgaaatgcaggtggtagaggttcttaatcctttagcaagggagttcaagtcaattggaaccttgaggaaagagcttgcagaattacaggaagaattggcaaaagctcacaatcaggtattgtactttcaggagacaggagccaaatgaaaaacttcaatattatatggattctgatgttttacatgtctaatccaggttcatctgtcggaaactagagtatcatctgcccttgataagttggcacaaatggagacccttgtcaacgacagactgttgcaagatggaggctctagcgcatctacagccgagtgcacttcccttgctccaagcacgtcatcagcgtcccgtgttgtaaacaagaaacctcctcgccggagtctgaacgtgtctggtcc

SEQ ID NO: 30 - protein, 1158 aa, Unknown
  Metagenome-Derived Sequence
  MISC_FEATURE (1)..(1158): Unk1 Csm1 protein
MENFKNLYEVRKTVRFELKPSRKKTFAGGDIFELQKDFEEVQKFFLDIFVFAIEQEKLYQEEEEEGKLSRYTKIEFKKKREIKYTWLRIYTKNEFYDWNGKNDKEKNYALSKIDFLEKEILRWFNEWQELTVNLKNLTQTKEHEKERKSDIAFVLRNFLKRQNFPFIKDFFNAVIDIQEKQGNESDEKIRKFREELREMKKNLNTCAKEYLSSQSKGVLLHKASFNYYTLNKTPKEYENLKLQKELEIDNILPKKICKRVRWNKEKKQEDILFECNSDWLVEIKLGYDIQKWTLDEAYQKMKTWKADQKSDFNEKIGNFIDQYLKKGFIEDLMNENEKKNAEAILREFSVFKPIENFYFYDFLERTKEIKILSNQKNNILQKYNKNAKYFEKIITYKIKDKEDLTEDEKEYQELEKSIEKKAKERGKFFNAPKEKVQTQHYFELCELYKRIAMKRGKIIAEIKGIENEEVQSQLLTHWALIAEEGEKKSVVFIPRKNGEELENHKKAHEFLQKQEKKEFGDIKSYHFKSLTLRALEKLCFKETENTFTPEIKKETNPKVWFPKYKQEWNDEPQKLINFYKQVLQSKYSQKYLDLVAFGDLKSFLETSFDDLQIFESGLEKTCYIKVPIYFSKEGFETFTNRFDAEVFEITTRSISSESKRKENAHAEIWKDFWSKENEEKNHITRLNPEVSVFYRDEIEKKSNALRGNNKSNINNRFSASRFTLVTTITIRATHKKSNLAFKTEEDIKSHIDKFNEAFQNFSGEWVYGIDRGLKELATLNVVKFSDEKNEFGVIKPKEFAKIPVYKLKDEKAILKDENGKDLKNAKGEARKVIDNISEVLEEKKEPDSNLFEKQGVLSQGISCIDLTQAKLIKGHIILNGDQKTYLKLKEISAKRRIFELFSTSKIDKNSELRVEKTTISINSEDGKRDFYWLTKNQIVNSETKKEIQKEQQEKLDNLKVIFIDYLEGLCVKNKFEDIETIEKINHLRDAITANMVGILFHLQKEFKGIIALENLDTVREQSNKKMIDEHFEQSNEDISRRLEWALYRKFANMGEVPSQIKESIFLRDEFKVYQMGLLKFVEVSGTSSNCPNCDKEVGKTNSHFVCKGENNCGFSSKENRNLLEQNLNNSDEVAAYNIAKRGLKLINQKWNNTSKSQN

SEQ ID NO: 31 - protein, 1290 aa, Unknown
  Metagenome-Derived Sequence
  MISC_FEATURE (1)..(1290): Unk2 Csm1 protein sequence
MNSIKNEYQLSKTLRFGLTKKKKLLKDDCNEIIYESHTELKELVLISEKKIMESVYINQKAKLDLSVDQIDTCLSSIKNFIDSWKGIYPRADQIAIDKDYYKILCKKITFDGFWIDEKTKTKKPQSRTILLSELSKKDASGKERKQHILDYWKNNIFSAIEKYEVVSRELKQFQKALKIQRTDNKPNEVELRKLFLSLANIILDILKPLVNGQICFPKIEKLDISKTDNKNLIDFATNHKFQSDLLNEIAELQHYFEENGSNVPFCRASLNPKTIIKSKLSTDNNIDKEIKQLGLDRILNEYLSAPYFDNSIIHLSAKEKLNKIEDKKENYITRGLLFKYKPIQIMLHHEIAKTLSKEIGKSEENIIEFLGNIGQIKSPAKDYEVSKEDFNINNYPLKVAFDFAWENVARNLYHTDTHAPIDECRKFLADNFDIKIEDNNLKLYANLLELNALLSTLKYGKPKDETSIKQNIKDLLNKISWNEIGKSGQKNKTNIENWLNNKDKIDNQNGIENAKKQIGLFRGSLKNKVPKYYKLTETYKDISMKMGKIFATMRDKITDEAELNKVSHYAMIVEDDNKDKYILLQEFTDKKEECIYSKTQTHNSDFTTYSVNSITSSAIAKMIRKVKAEELRKNQYNKDTFSIEETKEEKENRIIKEWKQFLKDKQWDYEFNLDTKNKNFEELKKEIDSKCYKLNISYIDKKTITDLVENKNCLLLPIINQDLSKEEKTQNNQFTKDWDAIFSQNTPWRLTPEFRISYRKPTPNYPISDKGDKRYSRFQMIGHFLCDYIPQSNTYISNREQIANYKDNEKQEQAVQCFHDKLLGKTEKEAKNEKLIALQAKFGSISRTNITQEKKKEKFYVFGIDRGQKELATLCVIDQDKKIIDDFDIYTRSFNSKTKQWDHTFLEKRAIMDLSNLRVETTISIDGKTEKKKVLVDLSKVKVKDKQGHYSKPDKMQIKMQQLAYIRKLQFQIQTNPDVVLAWYSDNNTQDLILENFVRKDDNDNKGLVSFYGAAVEELKDTLPIEEILNMLKQFKELKEKEKAGENVKYEIDRLIQLEPVDNLKTGVVANMVGVIAFLLEKFNYQVYISLEDLSQPFDNKINGGITGVPIKTNKESGRMADVEKYAGLGLYNFFEMQLLKKLFRIQQKSTTILHLVPAFRAQKNYDHVTVGQDNIKGQFGIVFFVNANATSKTCPICGANNSEKPDKNKYPNAHKELAKDGKEVWIERDKSNGNDIIRCFVCGFDTTKTYEDNPAKFIKSGDDNAAYLISVSAIKAYELATILAIEKYK

SEQ ID NO: 32 - protein, 1091 aa, Unknown
  Metagenome-Derived Sequence
  MISC_FEATURE (1)..(1091): Unk3 Csm1 protein
MAGTPYTGHVACKYCKITSWATYDRIKINKINMNQSFINGQNFYELRKTIRFVLDPKTLKRPYTPSSDEVNLEEQLNNFIEKYQQGINDFKYIVYFGPKTAETKELNKKISIKHSWLRNYTKSEFYSIKDKLIQLDYNGNKASIGNSNLKFLNEYFENWISENQECADALKNCINAPAEKQKRKSEAAHWVRKLTKRSNFECIFELFNGNIDHKNSNDDIEKIKHCLNECKTLLTSLEKMLLPSQSLGMEIERASLNYYTINKKPKNYDEDIAQKASALNEAYQFKADDKAFLNRVGFSDDGVPINELKEAMKKFKADQKSKFYEFVNQKKSYSDLKKNDDLKLLNDISEEDFNKFKETQDKMTRGKHFQFSFPNYKKSEKNFCDLYKNVAVAFGKIRADIKALEKERMDAEKLQCWAVILEKDNQRYVVTIPRDANNNLTNTKQYIDNLQNEENDQWILYAFESLTLRSLDKLCFGLDKNTFIPAITGELYQKNNSFFEKGLLKRKDQFSQNGTDLAAFYKTVLELDSTKKMLGINKYADFKAFISKEYTALEDFEKTLKETCYFKKRVFISEDTKNKLINDYQGNLYKITSYDLEKDDSEALGTLINKKQFNRASPEIHTKTWLDFWTADNETDKYPIRLNPEFKISFVEKQDKDLNMRNLGLLNKNRRLKSQFLLSTTITLLAHEKNADLHFKKTDEIQTFINSYNQEFNKKIKPFDIYYYGLDRGQKELLTLGLFKFSENEKVSFTKQDGTVGEYSKPKFIPLDVYQIREGQYLTKNKKGRLAYKSIDQFIDDEKVIEKLPVNSCLDLSCAKLVKGKIIQNGDVATYLELKRVSALRKIYENTTRGQFKTDRIGFNKDKGCLFLDIENRGKLENNNLYFYDNRFAEILSLDSIIKELQDYYNEVKNKQNIEFISIDKINHLRDALCANAVGILAHLQKTHFGVIVFEGLDARHKNKETTEFAGNLASRIERKILQKLETLSLIPPQHRQIIDLQNSKQIKQTGAVLYIEEKGTSANCPHCETANPDKSEKWLAHNYKCKNSNCNFDASEISKRKDLIGLDNSDSVATYNIAKRGLLEMNQKIEQSKV

SEQ ID NO: 33 - protein, 1108 aa, Unknown
  Metagenome-Derived Sequence
  MISC_FEATURE (1)..(1108): Unk4 Csm1 protein
MEKFKITRTIRFKANPISINKLQDQTKSLSENSEADIVGIINNANQIINDLEGLIFTNEEKNNLRKDVTIHFRWIRQYVKNDWYAWKEKQTNNSKQAEKGKSKSAEKDQLKSPLAQLALLRDKFPDAHKTSKTIQSSSPNSNKESSEKKLPLGDVPFLKEEFTFFCNYWREIAEKLNEAYSREEHNRMRRADIAKHLNELSKRQILPFLSDFLANGNDKKNDEKIKNLIVKVIEFKKDLEIAKNAYLSAQSSGIMLARASFNYYTLNKKPKDFDSEERRIIENMNAKYYQPGNIPQIIKDLKIDGSLSIEKLYEELKSYKAEQKAKFQEAISQGLKFEELQAKFPLFETTQEIFNDYVSKTNLITQKATQKNNTPKGSMEFKRLQDEINKLKRERGKMLQQGKFRNFKALNEEFKRVAVKKGKLKAQLKGIEKERIDSQRLQYWALIGQEENKYKLILIPKENVSKAYTEIVNQRWIDDRVSMYLYYFESFTFRALRKLCFGVNGNTFMPEIKNELPKYNQQDFGEHIFKTEDGKGDEKALVEFYQQVLKTDFVLKNLALPHQQMEEVTTTTFKDLNSFKIALEKICYNKKMVASPRVLRNLELSYGAEIFELSSQDLLKEHSTNLKNHTKIWNLFWSKENEEKNFDTRLNPEIGIFWREPKASRIEKYGEGTAHYDPQKKNRYLHPQFTIAFSINENALSNDLNYAFEGFEKQKEAMMEFNQKINKEFKDGMEQKKLGAFGVDTGEAELATIGLTDNGKPFPVKVLKVKSDKLNYSKQGYFKDGAMREKPYKAIDNLSYYLKKDLYDKTFRDDHFEQTFREIFEEIETETIDLTSSKLICEHIVVNGDLHTRSKLNILNAKRQIRQALITNPNLEIKFEDNKILISETDEERKKINPWKAVYHTNEELEQIKYFEAVKEEIEQYLKKVQDDSAEVLQNINRFREVAAGNMTGVIFHLYNKYPILIAIENLAQGTIEKHRLRYEGVMDRPLERALYRKFQSIGLTPPVSDLIAIRDNLTQKKKDKMSQLGVLQFVDEQNTSKTCPHCEKNAYEGERKNLYLEEKKKGIFSCGHCGYQNINNPMGLSLHSNDAVAAFNIAKRGIKNLKK

SEQ ID NO: 34 - protein, 1113 aa, Unknown
  Metagenome-Derived Sequence
  MISC_FEATURE (1)..(1113): Unk5 Csm1 protein
MAGFDKLKNQYEVKRTIRFNLTPVHFSYKKISSESFESKLKEFVSVYGDVIDSFKRMMFIEEYGEISLNRDIHVRHEWMKIYAKQDFHLNKEIIVRYRKNRKGENIKSNTDTSLEKTPFIFDLFNKFLMDNLSSDDYKDGILSNLEVIIREPLDEKSGKSNLSYLLNKIQKRSNFEFIYQLFKNMQSKKSDFEIEECKKKLDRCKELLLSLNHYLTPKNSSGLEVERTSLNYFTVNKKPKDYKGEKKRIYDKKNIPINNRVLNGNQSKYNEVLKESGFYNRYNKKNFSDFSLEEFYKNLKEFKAEEKSKFFELINFGASLNRINEDIPLFELSDIERGKNKELSFDSFQKETEKIKKLSDDLNGQLNDTLKKEIKELKIKRGRFFNVNDDENCPFQRYITYTKLYRDVAMEYGRIKADTKNLEKEEINAERLASWSVFVKIENGYFLMTIPKHKDNHSSLSSAYYDLKDTKSVDGEYNIYITESLTLRALEKLCFGLDKNTFVNEDFLEELNMLSPEYIVHKDGKKSIKRKDEILKESELKLINFYKKVLSMITTKKRILINDFKDNSCKDNYLSGDIKTLRDFQIALEKKCFTRKEVRVSKDFLNDFRNKYSAKLYKITSFDLEKRRENPESHTNLWEIYWTQSNEGGYTTRINPEMRINFIDKREESIKDKSGNEVERNRRKDKEFILSLTITEHNDKPKFDMAFADKKKVIKNINDFNTTLNSKLQDGKLGIYYYGLDRGEAELVTLGAFKFLDEIVKVDTGCLYNKPKAVKIDVWELPEDKLMEQVPYETKSGTMYFDAYKNISKCEHLLIKKETESCMDLSCAKVINGKIVLNGDISTLINLKLENAKRRINNHLYDFMKAKYKKDGKVDIRIEYKEKTKNKPERFDLYINNGEFKELGIYYPKFAIEKKIAMTQLDQYIVELRDIINNQKSVGLNIELEKVNHLRDAISSNIVGILNFLYKDFPGFISLENLETDDKNEKLGKSKVNLASRIEYKLLNKFKTLGLVPPNYKMVMSLQSKRDISQLGILNYIETSGTSSNCPHCGQSINDKEREENKWRNHQFRCSHCGFSSYENEDHKGLDFLNSSDDIAAYNIAKRGLEYINSLKK

SEQ ID NO: 35 - protein, 1255 aa, Unknown
  Metagenome-Derived Sequence
  MISC_FEATURE (1)..(1255): Unk6 Csm1 protein
MNHIYNNYQVSKTLRFGLTQKQKIRRPGYTGELYESHKVLKELVKISEEKVKNLIVPAKNEELLSSLDSVKWTLTEIREFLDQWRYIYNKSNQIALDKSYYLILSKKLGFNDEKKSRVIKMIEIKDDIKEKIINYWAFNLNESNQKLLMVNEMVNTQLKALEINRTDHKINEIELRKALQSLFNTVLDILKPLVYREISFINLEKIEKDSKNSLLEKFATDFQRKIDLLEKIRSLKTHFSENGGNVSFCRATFNPKTAIKNPKSNDNSILKEIKKLGIKDILENNENVFYFEKKLAEITAKEKLEYIIKDSESFLIRSLLFKYISIPAFLHHGIATELAPIISKEKNDLINFMISIGQIKSPAKDYADIPNKNDFNVNAYPIKVAFDYAWETVAKSQYHHDINAPVSMCKTFLDENFENCTKTKYFTLYSDLLELHTLLSTLDYGNPSMEDSIIDKANKIIAKIDNKEHKTKDKDLDKDIDKYKETIKNRLNHKNFNDKQRYSDAKKELSQFRGKLKNENDIYRKLTESYKKIAMNTGKIFAEMRDKISNASEQNKISHHALIIEDHNKDRYLFLQEFTTDKEKQIESICNDQAGQYIVYWVNSITSKSISKMLSKKRIEKLKQKKIINNSIKTSILSDAEKEARDIKEWVSFIKEKGWDIDFNLDLQNKNLEEIKKEVDAKAYKLKETLISQKTLSNLVKEGNCLLFPIINKDLVKKVKTEKNQFTKDWNSIFKKDNLWRLTPEFRVSYRQATPGYPTSDIGTKRYSRFQMTAHFLCDFLPQGTKYISNREQIENYKSSEKQKEAVEIFHQQIENDNNNVISTQSLNHLARHFGSKNIKKKHNTIEKKFYVFGIDRGQKELATLCIIDQDKKIEGPFKIYTRSFNTKTKQWEHQFYEERYILDISNLRVETSISIDGKPDQQKILVDLSYYKEGEKFIKLPKMQVKLQQLAYIRKLQYQMQRNPETVLDWSYKNTDDKSILENFVDKPNGEKGLVSFYGAAVIELKDTLPLSEIKDMLERFKELKGKEKNGEDVSQQLNELTQLKSVDHSKYGVVANMVGVIAHLLERYDYKAYISLEDLTKPYSAIDGITGQKTDAKSISGKQQDVEKYAGLGLYNFFEIQLLKKLFRIQKDSQNTLHLVPAFRATKNYENLIAGEDKVKNRFGIVYFVDPKSTSIMCPSCGKTNNSSNKEKRVVRDKKNGNDIIYCEFCGFDTRNDYKENPLKFIKSGDDNAAYIISTHTAKKAYELAKSIL

SEQ ID NO: 36 - protein, 1255 aa, Unknown
  Metagenome-Derived Sequence
  MISC_FEATURE (1)..(1255): Unk7 Csm1 protein
MSLAAFTNQYQLSKTLRFGFTQKEKVRKENFDGSIYQSHAALRELTIESERLIKGKLKSNTDTALPLEKIRACIEEIKRYTDTWSKIFTRDDQLALSKEYYRVMARKARFDAFWKNYRDVKQPQSQIVRLSSLKSKYNGKERKAYLVDYWAGNLQTVKQRLVDFEPAIRQFESALKDNRTDRKLNEVDFRKMFLSICKLVNETLVPLCNSSLCVPDLEKLLDNEASQELRDFVMMDIFQLQEQIEALKIYFGENGGYVPYGRTTLNKYTALQKPHAFDEEIEAILVKLKLSDVINNLIKQDDVSDYFENVKDKIGQLSNSSMSVIECVQLFKYKPIPVSVRYSLVEYFHRKLGIDKDELGTLLDTIGKPKSPAKDYADLQDKGDFNLYKYPLKVAFDFTWESLAKAQYHEGLNFPEVQCQKFLENIFFVNTSCEAFKTYALLLHLRGLLAKLDHEEPNDREAIIDKAISLMNEDAFPKVPLRGTKGDSANQAILSWLQLSKEEQVYKKEKKDQSYNQYEKAKNKIGLLRGEQKNKIGKYREVTEQFKDLASNFGKLFGALREKFQAKNELNKITHYGTIIEDNNQDRYVLLYPLSEGIIDLDKLFVHEESGTLTSYYVKSLTSKTLNKLIKNKGGFKDFHMDGQQPDWERVKKRWSVYKDDKAFLKYVKRCLNESEMAKAQNWGEFGWDFSSCDSFEEIEREVDKKGYSFKNDRKLSEDTVKRLVKEEKCLLLPIINQDIIVEETKLRNQFSKDWVNIFDADCTEYRLHPEFGMSYRMPTPNYPKPEQKRYSRFQMIGYFQCEIVPIKTEYLSKKEQIEIFNDADAQKEAVEKFNEIVNGSVKPNDYVVIGIDRGLKQLATLCVLNKDGAIQGGFEIYTRSFNADKKQWEHRFMDNRDILDLSNLRVETTVDGKKVLVDLSSIKVKDQRGNYTQDNQQKVKLKQLAYIRKLQYQMQVNPEKVKAFAAQHRTPQDIKDHMKELITPYKEGSHFADLPLDRIKYMLEAFCAFHTENDQTSLRELIELDAADNLKSGIVGNIVGVIAFLLKRFSYNAYISIENLTRAFYNQRDGLSEKEIPRDHDFMDQENLVLAGLGTYHYLEVQLLRKLFRIQCDAGIINLVPAFRSNDNYETTRKLSKKQGVEYVCKPFGIVHFVDPMYTSKKCPACGGTTVQRGSFKDDITCQNPLCGYGTSLDISEKIQKLISANKAGQNIHLISNGDENGAYHIALKTLKNLFGNIQNANNERRYVKSFRSK

SEQ ID NO: 37 - protein, 1046 aa, Unknown
  Metagenome-Derived Sequence
  MISC_FEATURE (1)..(1046): Unk8 Csm1 protein
MTHQYEFTRTIKFNLNNKKDNDAAQLKKFFSDEHINFQELFNDFEGSFSALLDQFKKAVYLKSGNNFGNNLRVKNSLEIKKSWLKQYARDEFYKIDEKQRKYNKFPANLFQSIFNGWLKRNESLLEQFKKINQMPQESQIKRSEILTLLQEIKITDNFLFIKNFVQPGIANDKNSDSDLENLKEKVDQFEILMNKAIFAMAPDLSQGVEVCRASLSYYTVNKVSKRDFDTELEGKRKELKQTYNKELNQQLLQTVGFLDYLENEYQSDIQLVSIQDLYKALKKFKAQKKSEFMQAVQQGKQAEELIKDFPLFNVQKDVMQNFINISNKIDEKNLQKQKSQNEKEKKGLTEEIRKLRINRGKYFQNRWGFPNYVNFCNNVFRPVAIKIGNLKAQIRAIEQEKIEARLLQYWAHILKKGNQYYLLLIPKEKMQEVKDFLNNSSPSQEGEYTLYSFNSLTLRALKKLIRKNLGKEQTHLQNDNTAIELYKKVLQGKYSELQNLDFSGFEEKIKEIVQGNYNSEEYFRLKLERVAYCCFEQKISQETIAHLHRSFSALLLEISAYDFERNISSKMKEHSKVWQEFWTVENKNEHFPIRINPEIRIFYRPKREQEDLQKGKNRFAKDHFGVAFTITQNAAQKNLDLAFAKEKEISEAVKKFNEEIIGEFIKEKGNDLYYYGIDRGQQELATLCVVKFSEKQGKTKLANGEMRKFNIPVPVPIKLKLYRIKEDCLNSEKEIIIDRYGNKKNVKMFENPSYFIDEKEKFEEIESTCFDLTTAKLIKDKIVLNGDVRTYIELKKANGKRQLFEKLSKIEDKAEIEFCEDENGKRFQIKSKTTEINKYQYIIFYSPEDEKIMPRDEMKKYLQNYLNNLRNGNLAKENISIEKINHLRDAITANMVGIIAYLFLFKKYQGIINLENLIETHFSQNNENIERRLEWSLYKKFQKFGLVPPQLRQTVFLRKENNQLNQIGIIHFVSKKNTSACCPRCGNIVPMRKRETDKFKYHTFICDKCGFNTQNPKSPFDFIKNSDEVAAYNIAKSNLNKFYYNG

SEQ ID NO: 38 - protein, 1114 aa, Unknown
  Metagenome-Derived Sequence
  MISC_FEATURE (1)..(1114): Unk9 Csm1 protein
MLQKGTSKMLIQFKNHYSYNKSIRFKLEHKNGKLPKLESDNVDLNKLVDIGNSLKDIFEELVYTKNNYNKLNSLVSIKKQWLKIYFKNEFYSNGKIQNYSLSNFSYLPNKLIEWLNNWQNNLKALIELTKQQDFNKTKKSEIAYILSLFNGKYSFSFVKDFSTCINHKNSQEQILKLQGVVENFEKVLNLCIQEYLPSKSAGVVIAQGSMNYYAINKEPKRYDNILADLNQKFEELDKEYIAMKQYKSSQKSRLFEFIRKGFSKDQILSEFKKKENNEVSFVYNNQIIIRIYTQELFKDSYCLGEVIKLTKKIEELNESKDSNNNLPEETKKEITKLKKEIGFYFIRRTRGKSHNNYFKSYYGFCNDKFKKKAQERGRLLTKIKAIRKEKIESQNLRYWSLILDDGKDKFLWLVPKENMQEFRRELSKIHPSGESSLFLFHSLTMRALHKLCFAQESDFVKEMPKVLKEEQLNCEKASNDTETNKRIKRNFGLNYIKTKDELTLSFLKKLIISEYAHERLDLNHFDLSKLQVATTLNEFEEYLEDACYYLEKISISSSMIKELLEEYNILNFRITSYDLEKRNKNTYQTPESDIKRHTKEIWNKFWEGDRFIRLNPEIKIRYRQKNQNIEDYLKEKGFDLTKIKNRFLQEQYSVSFTFALNAGKKYPKLAFVKTEEILEKIEEFNDEFNKQYFDNSYKYGIDRGNIELATLCITKFNKNDTYEYKGKKYLKPNFPTSQEDIKTYELKNEWYKRTAISNIETKPKNKKTPKRIIANISYFIDNVENEEWFNKKTCTSIDLTTAKVIKGKLILNGDVLTFLKLKKEAAKRILFELVAQNKLTAKNKELKWKSDDGNNSDSVRLICDVLDNETNSIYFYEDSKYGRGFEGLLTTDKTAYSKEGIRINLQNYLNHLISEKENKSNKAYSHVPSIEKINHLRDALVANMVGVISYLQAYYPGIVVLEDLNHKLLIKHFEDLNINISNRFEHALIEKFQTLGMVPPHIKDYLEIRSSFRMSRNDSSQFGALIFVSKEGTSKECPYCEKKWNWGKEKEIELKFSKKQYICGKENSCGFDTKHIQNTFEFLSEINDPDKIAAYNIAKRGFKSFINKSSIKKQ

SEQ ID NO: 39 - protein, 1033 aa, Unknown
  Metagenome-Derived Sequence
  MISC_FEATURE (1)..(1033): Unk10 Csm1 protein
MENSNLYQVVKTIRFKLEPVGKMDTPKFGDKNAESKANLTPFIELVKKTMTNVKALVFSKQDGEDGEKWRKILEVNYRFLRSYLKNSFYENRGDSQEKSKKHKISDLEYLQKALENLFAEFDEILDGLEDFEKRNTKNQYEKQRHAQAGLLLNRLCKRSNFGFLKAFVGALAQTNKPFFDDKTDKLKKQIDKFETELEKQKEFFLPYQSNGVLFAGGSFNRYAINKTPKMLDKELREEQTNLKKSLCEHKIKIDTLNTLGLKNDCPCTSLDNSYTFIKDYKAKQKSKFIELVQKGEFDEAKKVNLFECSETDFETFKTRTKQIQNEKDKDERTKLKQKRGEFFKSQKRGKFFKSQTQNYENLCDLYKKIAQKRGQIVAKICAIKKEKEMCEQVKYWCVALEKGGEFYLYMFLRDENDNIKNAYDFVSKLQTQKSGETKLHYFDSLTLKAVRKLCFKETDGSFKKALKNVKFPECEQNLDEKVKISFYQNVLKNAKTLNLSKFENLQSVTEGKFESLSEFEVALNMVCYTKTVCVSESVEKELKKFKPLVFHITSQDLAAKREKKAHTQIWHEFWRESNEKSKFPLRLNPELKVMWREARPSRVEKYAEQSDKFDPNKKNRYLHPQFTLALNFTQNAHNEAINLAFKDVQNKGEAVKKFNENFKSSEYAFGIDVGTKDLALLCLIDKNKKPVNFDVYEICNENEICNEKLGFEKFGFYKDGTRRDEPYKLIKNPSYFLNESLYKKTFNATKEEFERSFSELFKRKSVCALDLTTAKVICGKIILNGDFSTHLNLKILNAKRKISAKLKKDPTLKIEYDNDDNILFGSNVIFYYNNKYEIVRPYDEIKNEIFEFHEKQRLDDARLEDNINKTRANLVANMVGVISFLHKEFSGFVVLENLKQSEIEGNHRLKFEGDITRPLELALYRKFQSKCLTPPISELIKLREGEKNENVESDLILQFGIIKFVDKDKTSRLCPACGKDAYENNNSKYKTDKKDGVFECAGCGFNNKNNAGDFAALDTNDKIATFNIAKRGL

SEQ ID NO: 40 - protein, 1234 aa, Unknown
  Metagenome-Derived Sequence
  MISC_FEATURE (1)..(1234): Unk11 Csm1 protein
MEKNEIAISEYQTQKTIRFGLTATNQNLYSEEIMKLLDISEKRVEKQAEQAKKVNNDADKNNQLRCCLDQIKEYLKTWSNIYPQIDFLAITKDFYKVISKKARFDFDKGNGSEIKLSYLQSTYYNKKRYLYIIESWKENLRKTENLYRKSDDLLKVFEEAKNQNRDDKKLNKVELRKTFLSLFNLVNESLKPLIEGNLFIVNDDKIDEQNPKHDCVSVFISKTEERRKLYDYICDLQDYFKDNGGYVPLGRVTLNKWTALQKSNNRDAEINRIIKELKINSVSIQNIEYEYNNFANNFKEKKDENGKIVKNNAGNIIWDLKADAKSVIEICQFFKYKQVPINARLNLAKRLEKSIDFLSEFGVSKSPALDYKNDKNNFNLTNYPLKIAFDYAWENCAKAKHEEIPFPKEQCEKYLKDVFDIDIECKEKCQNKECKGCEKCRGYYLNKYADLIRFKILLGRLKAEFHKTDEEKNKSNIQELRNIFRDLDYRGDKRLNKNEIQKAVNAWFDNKEQSIGRKKEDEIHLMENEKNKFSLSMQIIGQERGGLKSRISKYKALTEMFKVCASKFGKQFADLRDYFNEAYEVDKIKYRAWIIEDEKQNRFILFVNKEKEVDLTSEEGDLYFYEVKSLTSKSLVKFIKNRGAYPDFHKINNRQIDLNSGEKDSRGNFIDDVKIHWSTYKNNQKFLDKLKDCLQNSTMATVQKWSEFEFEFDFSNCDTYEKLEKEIDRKGHKLERKTISLTTITNLVENTACLLLPIVNQDLNKGNKQAKNQNQFTKDWFDIFENKKRLHPEFNIFYRFKTKDYPNTKFKNGTEKTKRYSRFQMLAHFGCEVIPQGDYLSKKEQIAIFNDDKKQTEEVKKYNKNISSDVDYVIGIDRGIKQLATLCVLDKNGVIQGGFQLFTRTFNSETKQWEHQELEKRNILDLSNLRVETTITGEKVLVDLASIQTKNGENRQKIKLKELAYIRDLQYTMQTRASDLLDFASKINSADDITENNIKNFISPYKEGEKYADLPQKEMFDLLTEWKNAEEEGKRKIAELDPADNLKSGIVANMVGVVALLCAKYKYRVRIALEDLTRAYGIQKDALSGATIFQNDEDFKEQENRRLAGVGTMQFFEVQLLKKIFKVQIDKDLHLIPAFRSIANYEKIVRRDKQNSGDEFVNYPFGIVCFVVPKYTSKRCPKCEKTNVNRKENIVICKECGFQTKEGNPYEKNNIHFITDGDQNGAYHIAKKAL

SEQ ID NO: 41 - protein, 1056 aa, Unknown
  Metagenome-Derived Sequence
  MISC_FEATURE (1)..(1056): Unk79 protein
MKDYQNFYELRKTIRFILEPKEIKRPYQPIVNNDDLGKRIDNFINKYGHAIQIFRELIYAAPRDSEEKKLSKNISVKHSWLRNYTKNDFFNVKEKIIQYDKDNKKRGNKIAIDNTNIKFLNDYFENWLEENKECIANLKICLNQPEENQKKISEFAYWIRKITKRSNFEFIFELFNGSIDHKNSNEKIDAAKKELDECKPLLALLEKAVLPSQSLGVEIECASLNYYIVNKKPKDYPQEIQNKKNELQQGHSFSRNEQNVLNQVGFIDIKLPITDLKEAMKKFKAEQKKIFYEFVNKGEMYQELKNKVDLKLLNDISENNFNKFEKETDDQKRGKHFQFSFQKYKNFCNIYKNVAVKFGRIKANIKSLEREKVDAEKLQSWAVILEKDNQKYILTISRDAKNNLQNAKKYIDDLQNENGGQWNLYALESLTLRALDKLCFGSDKNTFMPAIKNELLQNDNSFFINGDLKRKDQFSEDGKELIKFYQTVLSLGSTKEMLAIDNFKNFDELAIKEYGELADFERLFKKICYYKKSIAISEDTKKKIVDDYQGNLYKITSYDLEKDDAEILASLQNKNHLGRSHPEFHTKIWLDFWTDGNEEKNYEVRLNPEFKINFVEKHPDELKDRDLGKLKKNRRLNEQFMLSTTITLNAHGKNTNLSYKTTDDIKKYIEKYNDEFNKKIKPFDIYYYGLDRGKDELLTLGLFKFSENEKIKFIKQDGTPGEYNKPEFIDLEIYQLKKEKYLAKDSRNRVAYKSIDLFLDNIGIIERISVESCIDLSCAKIVKGKIILNGDIATYLELKRVSALRKILEGAAKNKFRSDKICYNADKGSLFLNIENRGKLENDDLYFCDDRFDNILSLDAIQKELQDYYDGIKNNSGNAEMIPIEKINHLKNALCANAVGVINYLQQKYFGIVAFENLDMANKNQRISEFSGYLGSMIELKLLQKFQTLSLVPPGLKQVMSLQNFKEINQIGAVFYIETCGTSNKCPRCGTENSDKSQKWNAHAYKCKNNNCNFGTTEDKTRNDLIALDNSDKVASYNIAKKSLAELHSKCSLKNE

SEQ ID NO: 42 - protein, 906 aa, Unknown
  Metagenome-Derived Sequence
  MISC_FEATURE (1)..(906): Unk14 Csm1 protein; Xaa=Gly
MEKNYKSEINLSYEDILNKFNLLXRAIDIANDFKNSNNQNNFSLDEYPIKLAFDYAWENTARSLKRTIPFPKEVCKQFLKDNFDVDIDNADFKLYANLLFIADNLATIEYNNPNNEVELINEIKQAFECISFPFDKEVYKXHKEAILELLDKEKSQRDYSTILKAKQELXLLRXXLKNKIKKYRDLTQRLIDKKNSHFXIASFVGKTLATIRDGLKEENELNKISDYXVIIEDSNQDKYLLTLELNGKDIRDRIRNSLXNXEYKTYEVNSFTSKALNKFIKNPLSEDAKKFHGKYKDEYSFXYENKDXDFTYKITKVSKYDEQGKWTXYQESFLSHIKKCLIDSEISREQNWEAFGWNFAGCNTYEEIEKEVDSKXYQLTENLISMGNLKSLVKDEGCLLFPIINQDISSQKQENKNIFTLDLEKVFEXKECRIHPEFSIFYRRPIEEHKKENKSXIINRFGRLQLLANLGIEFVPRNPSFKTKKEQNRIAIDQKKQNQLVQEFNQKKVNTYFEGLDNYYIFGIDRXIKQLATLCVTDKDXVIQDFDIYTKHFNSESKKWEYKFHRKDXILDLTNLKIESDRSXNKYIVDISLFQAKDEDXNPTGTNKQNIQLKQLAYIRKLQYQMSANEEXVLNFLGKYKNKEEREQNMEELITPYKEXKNFADLPMDIFQEMFENYYRLKTDQNLSESEKKNLMKITTELDASESLKKXVVANMIGVIYYLMKKYEYKVKISLENLSNAWLFSKDGLSXDVVLNTKNDETMDLKKQDNLALAXVXTYHFFEMQLLNKLFKISTEEXVLHLVPSFXSVKNYIEIMKIKGKYVYKQFGIVYFVDPRNTSKKCPVCXKXXKKYISRVDNVVTCKNCXFDTSSDNSILINNYKKQXKNIHFIKNGDDNAAYNIXEKIR

SEQ ID NO: 43 - protein, 918 aa, Unknown
  Metagenome-Derived Sequence
  MISC_FEATURE (1)..(918): Unk15 Csm1 protein
MIEPGNYVYLRQILKNIKLEQKNKFSKLMQSKSLTFHDLNNNNQLYLFKDILEGEFNKYKQKTNEIETKAEKRNQCNNDELKRKLNSELQQLRKDRGSLINAADGRPKGRFKTYKYFANFYRNVAQKHGRILSTLKGIEKEMVESQLLKYWTIITEENNQHSLVLIPKERAGEYKKDLENSIPSDPSSKIKVYWFESFTLRSLRKLCFGYVNNNTGSNTFYPELKKSDELRKYHDERGNFIKGEFYFKGDEQKIIQFYKDVLRSNYAQKVLKFPKQQVKDELIGREFSSLDEFQIALEKICYQRHVVCSQKVVDALSRYNAQIFLITSLDLGNPANCVDKPKQFSHFDKKHTRIWKEFWSSKNETANFDIRLNPEIVITYRQPKQSRIKKYGPESTRYDDRKHNRYLYPQFTLITTISEYSNAPTKALSFLTDEEFKGAVDEFNKKFKKENIRFSLGIDNGETELSTLGVYLPVFKKDSNEKVVAELKKVNKYGFNFLTIKDLSHVEKDKNGRVRKIIQNPSYFLSKEQYMRTFGRTEQEYNNMFAEQFEEKAFLSLDLTTAKVINGHIVTNGDVPTFLNLWMRHAQRDIWDMNDHTKEKTAKKIVIKNNDELTDAEKVKFVEYISDETNYAKLNFNEKKRYVLWIFENRKNINFTDAEKKKFEPCQKRKGNFSKDILFAVCYIGSEIHSVTNIFDVRNIFKMRKDFYVLKSEMEIKKEIESYNTTAGIQEISNEELDLKINRLKQAVVANAVGVIDYLYIYYKKKTGGEGLIIKEGFDTKKVAKALEKFSGNIYRILERKLYQKFQNYGLVPPIKSLMAVREEGIENNKDAILRLGNVGFIDPTGTSQQCPVCSKGKLNHTTKCSKNCGFNSKNIMHSNDGIAGYNIAKRGFENFISQKKGYDVINNGTKYNNLKSQ

SEQ ID NO: 44 - protein, 1011 aa, Unknown
  Metagenome-Derived Sequence
  MISC_FEATURE (1)..(1011): Unk16 Csm1 protein
MDYQQYEFTRTIRFNLSGDDKRALMLDLLDDTQEGMLAAFQETYKNLLFAFQEAILRADGSGNLRVGRLEIKKSWLRQYAREYFYALSEDERRCKNKFQAKLFDRVLSDWLERNNELLQRLNNILSLPQESKTGASDLSLLVRQLKGAEYFYFIRDFTQSGIINDKDSDEHIKNLAGIVEKFETLLDKVLFLTAPNSSQGVETTRASFNYYTVNKISKNFDENIKKANGRLCSSYQNSMNEELLRKVGFLKYLKDEYRAELQNVSLKDLYEALKKFKSQQKTAFIQAVQKNKSEKELMREFPLFNGKQPDTLQKFILETDKIKRGAYFQKWGFDNYISFCNKIFKPVAMETGTRKAKIRALEQEKIEARLLQYWAHILVKDGKYFLLLIPKEKMGEAKVFFARLSDQEGGEYTLYAFNSLTLRALKKLIRRNLGKEQVRLSAGDADAIALCQEVLRGRYHQLKDLDLSGFEKEIAEIANTQYENEEEFRIALEQVAYYLSERKMNEESIEYLKKNLGAILLEISSYDLERNITGESKEHTRLWSDFWNPNNKKECFSTRLNPELRIFYRPPREQKDPKKQKNRFSKDHLAVAFTIAQNAARKRMETSFAEEKDLVEQVKKFNEEVVGKFIDEKSDNLYYYGIDRGQQELATLCVVRFSKEHYEAMLEDNFIKKFSKPIPAQITAYRIKDEHMSYRKNITRDLKGNETEEILFKNPSHFIDEVENFEEVSTPCIDLTTAKLIKGKIILNGDIQTYLALKKANGKRQLFEKFAKIDDSAKIEFDDSEGRFQVKSKATEREEYQFLPYYGPEQENISPREDMRRELQAYLDKLRSSESFEEDISIEKINHLRDAITSNMVGIIAFLFTEYPGIINLENLHSRENIEKNWRKNNEDISRRLEWGLYKKFQKIGLVPPRLRQTVLLRENETERQEKLNQFGIIHFIPTEKTSARCPYCGENTPMKQRNEDKFKLHAYICRSNEENCGFDTREPKSPLEFIKNSDDVAAYNIAKKRL

SEQ ID NO: 45 - protein, 1029 aa, Unknown
  Metagenome-Derived Sequence
  MISC_FEATURE (1)..(1029): Unk17 Csm1 protein
MRKMFLSLANIVCEVLVPLCNGSICFPDIEKMSDKDENKYLREFAVDYKTKIDLFDSISELRKYFEENGGNVPFCRATLNPKTKIKNPSSTDNSIEAEIEKIGMEKYLQTTDEIITAINKIKQMQDSKLPLIKRALLFKYKTIPAVVQFDLAKSIGKKLNKEEQELRTIIRTIGQTASPAKDYADLQHKKEFNINQYPLKPAFDYAWESLAKAEYHNDIEFPNQICKQFLKDIFNVDTETDSYFKLYAQFLYLRELLATLEHSQPTNPEKIVKIIEELLEKINAWKEIDDKNSEKYKTAISNWLKTFNKEDNNFKNAKQKIGLFRGGLKKKAGDKSRWEYLRKPDEKEAPKLTAYNALTQIYKDIATNLGRNLADMRDKITNESELNKISHYAAIIEDKNGDKYVLLKKSDKDEEFALPCEKDAEYKTYIVNSITSSAIAKMIRKKRAADLAKNIRLKSEELNDEQKEAKNLKDWIELIKKQQYDFEFNLNLNNKNFEQIKKEIDAKCYQLQKGNISKQTLEKLINEQKEWLLLPIINQDLAKRDKSTTNQFSKDWQKIFSDKRCGYRLTPEFRISYRKPTPNYPQSQIGDKRYSRFQMIAHFLCDYIPQGNLEYKSTRQQIEIFKDYEKQEESVRNFTYKIYANNDYLIFGIDRGLKQLATLCVLNKEGKIYGGFDIYTRSFNKDKKQWEHSLSEKRNILDLSDLRVEKTITGEKVLVDLNSIKVKGNQDNQQKIKLKELAYIRKLQFKMQTEHGTVINFINKYRTPEEIQKNIHELITPYKEGEHYADLPTEKICNMLQKFKEFSDKNDGKSKRELIELDSAGELKNGIVANMVGVVAYLLEKYKYNVYISLEDLTRAYRRQTDGLDGRELFSSNDDKSVDFKDQENTALAGLGTYHFFEIQLLRKLFRIQQEDGNILHLVPAFRSVDDYEKIIRRDKKIDGNEYVDYPFGIVRFVDPKNTSKRCPLCSSININRHKNIIKCQQKACGFKTPWDKTNDKNIQYIQNGDENGAYHIAKKTLDNLNNKK

SEQ ID NO: 46 - protein, 1080 aa, Unknown
  Metagenome-Derived Sequence
  MISC_FEATURE (1)..(1080): Unk18 Csm1 protein
MDRFKNLYEVKKTVRFELKPSRKKIFEGGDVIKLLKDFKKVQRLFLEIFVYKKKDSKLEFKKKREIKYTWLRTHTKNEFYNWSRRSDIEKNYVLSKIDFLPEEILRWLDEWQKLTESLEDITQTEEHKQKRKSNIAFALRKFSKRQNLPFIKDFFNAVIDIQGKQGNESDVRIKEFRGRLKEIEKNFNACSKKYLPTQSNGVLLHKASFNYYTLNKTPKEYEDLKKEKELELNGVLSWAIYKRERVIDRRTEQTEILFDCDIDWLKKIGLGDEIQNWVLDEAYQKMKIWKANQKSDFIEAVARDKLTFQNFRKKFPLFDASDENFEICYKLTKELDKKPKDAKKVAQERGKFFNAPKEKIQTKNYFELCELYKRIALKRGKIIAEIKGIENEEVQSQLLTHYAMVAEEENKKFIVFIPRKNGEELENHKNAHKFLQGKEKKESGDVKVYHFKSLTLRALEKLCFKKTKNTFAPEIEKETNPKIWFPKYKQQWNKTPEKLIEFYKKVLQSDYSKKYLDLVDFGNLNTFLKTDFTTLEEFESVLEKTCYTKVPVYFSKKEFETFKDEFEAEVFEITTRSVSTGSARKENAHAKIWKDFWSRKNETAGHTIRLNPEVSIFYRDEIKEMSNASRQNRTSDVNNRFSDPRFTLATTITTHADKKKPNLAFKKIEDIKNHIDSFNTVFNRDFSGVWVYGIDRGLKELATLNVVKFSDVKNKFGVLQPKEFAKISIYKLSDEKAILKDVGGKSLKNAKGEDRKVIDNISEVLEEGKEPDPILFENRIVSSIDLTQAKLIKGHIITNGDQKTYLKLKETSAKRRIFELFSNAQIDKNTTISGNKTIMLGKNNTIYWLCEWQRQNPWRDKKESLMQSLKDYLQNLDIKNHFKDIETIEQINHLRDSITANMVGLLFHLQNKLKIHGVIALENLDTVQKKSDSKMIDEHFEQSNEDISRRLEWALYRKFANTGEVPPQIKESIFLRGEFKVCQMGILKFVEVGGTSRGCPNCQSEWNQECGNQCNPKCNKCTENDSYKKNKRKNVYICKDDNQCKFSTEESRNLLEQNLHNSDDVAAYNIAKRGLEINSI

SEQ ID NO: 47 - protein, 1085 aa, Unknown
  Metagenome-Derived Sequence
  MISC_FEATURE (1)..(1085): Unk19 Csm1 protein
MEKYKITKTIRFKLLPDKIQDISRQVAVLQNSTNAEKKNNLLRLIQRGQELPKLLNEYIRYSDNHKLKSNVTVHFRWLRLFTKDLFYNWKKDNTEKKIKISDVDYLSRVFEDFFNEWETVIERINTDCNRPEESKTRDAEIAFSIKKIATKQMFPFIKSFVYNSNYKNSEETKSKLTALLNEFETVLKICEQNYLPSQSAGIVIAKASFNYYTINKKQKDYKGYTDDIEKIEKGMNSKFHYERKYDQLLEELNLIALKELPLIEFYSKIKSYKSTRKIEFSEAVSKGLAFADLKSKFPLFQTESNKYAEFLELTGRITQISTAKSLLSKDNPEAQKLRDEIKKLRINRGEYFKNNFHKYISLCNLYKKIADKKGRLKGQVKGIENERIDSQRIQHWALVLEDNLKHSLILIPKEKVTEVYRKVRASKADSTSSSSSLYYFESMTYRALHKLCFGVNGNTFLPEIQKELPEYNPNKQSDFGEFCFHKSNTDKEIDEPKLISFYQSVLKTNYVKDNLNLPQSVFDEATVQTFETRQDFQIALEKCCYAKKTIISETLKKEILEDNNVQIFQITSLDLQRSEQKNLKAHTKIWNRFWTKQNETANYDLRLNPETAIVWRKPKKTRIDKYGAGTSLYDPKKRNRYLHEQYTLCTTVTDNALNNEITFAFEDTKKKGTEIVKYNEKINQTLKKEFNKNQLWFYGIDAGEIELATLALMNKDKEPQLFTVYELKKSDFFKHGYIYNKERELVIREKPYKAIQNLSYFLNEELYEKTFRDGKFQETFNELFKEKHVSAIDLTTAKVINGKIILNGDMITFLNLRILHAKRKIYEELIINPQAELKENEKEYYLYFDKEGTEKVEKIYRSRLDFEHIKPYQEIRNDLNAYFKNVQKNEAKVEDQINQTRRALVGNMIGVIYYLYQKYRGIISIEDLKQTKVESDRNKFEGNIERPLEWALYRKFQQEGYVPPISELIKLRELEKFPLKDVKQPKYENIQQFGIIKFVSPEETSTTCPSCEKKAYELQKEKKGEEKPAENKRYEADKKAGVFCCPKCGFHNRTNPMGYESLDSNDKVAAFNIAKRGFEDLQKHK

SEQ ID NO: 48 - protein, 1087 aa, Unknown
  Metagenome-Derived Sequence
  MISC_FEATURE (1)..(1087): Unk20 Csm1 protein
MDSIKKDPKEAMPRFETVRTVRFELKPSADTLEKLKAVLPRGDFQVDIEKFITGLRKFYSGLADIIIDKSEEGFALRRGIEIKYGWLRSYTKNDFYTFIEGGDGRLPIKYGISDVGYLKRELQRWFVEWKEIILELEGMIQAPLESQRRRRDFAQLIRGLKKRQNFEFIREFSKALCNTNDPATDHLIEDLRISINSLEGELQEVEAAFASSQSAGFQIARGSFNYYTINKDPKSLKTEEKEERDKLNRSLSSFKDKFGSQEFFLSGKFSFIDAATGEGRKEDSASWTLEESYGKLKEWKSGQKKKFLEAIQAKIITVGNFSSKFPLFESSKEDFLAFLDLSERMAEANKKKSREENEGRKKEIDKGIKQLAQQRGEFFNKPGKRVQTRKYYDICQIFKNIAFKRGGIVARISGIGNERRESQSLQYWALIMEEQKKHFLIMIPRGESENYKKARESIEKRLAERGEIKIYHFKSLTLRALEKLCFKEIGNTFAPELKKQGVRFPRYKQEWGGQEERMVKFYQEVLTSSYAHNLLDIAEFGDLQSLLKKEYKSLVDFRSDLEKAAYLKKEIYLADDEKESFLRNYDALVFEIDSYDLRIESENRPENKGHQDKAHTRLWKDFWTSQNKEIGYGTRLNPEVKVFWREADEELSKSLSSGKISQPRKLDYFRNRYSRNHFNLAITITSNAIERKNDLAFKSISDIEKYIQNFNDDFNKNFKGEWFYGIDRGLKQLATLCIMRFSKQSYPINGKSLSCPEFSRIEAWQLKDENYSEDVKREDGTQFRRSAIKNLSYFLDKAELFEKKMVSCIDLTTAKMIKGKIVLNGDLMTYFKLKEHASRRKIFSLFSESKINDSSEIKISKSGSTIVIKDNCQEYQPIYWISQRQEKKTKGMYREIETPEQIIKKLDGYLKDIGRNNINEDIITVDKINHLRDAITANIVGVVSHLQGLFPGIIAFEDMDEEDHISKHFTQSNENISRRLEWAFYRNFQVKGLVPPQVKSTIFLRKEFKDKQFGIVQFVKMENTSCNCPRCGEKFPKTSDHRHYICGNPGCGFSSLGNRMEFSPLDDSDKVAAFNVAKNAFNKLYEI

SEQ ID NO: 49 - protein, 1104 aa, Unknown
  Metagenome-Derived Sequence
  MISC_FEATURE (1)..(1104): Unk21 Csm1 protein
MKNYKLTKTIRFKLEADEKNISDIKKEIKSIEAKSNEFELANFVTELNNYIANIKAYLFYQRKDGLSAIKDKMTIKNEWLRQYAKQELVEFKVKTQKSNYTGNKRREQITISEISELSQKITKAFDELVVIYTELADSASLELNERARKAKIGLLLKRLCAKNTLPLLSSLIDNTSDKNETDDLSIRLKKQAIKINAQLLVGIRMYLPEQSGGLPITKASFNYYTINKKPVDFKERIEDLEKKLEVQDLEKLNIYFDKKKRTEKDYLEKKIFKLLEADVQKSLPKNQTLCLGEAPMIKTDSVSLRQFLKNIKAEQKKQFSELMQNNIPYEELEKSNLYLLNNIKSEQFTAYKEKTKKLEEIATKLSNQNLSEDVKKKLRSDKEKIAKERGGIMKDNFFAWKSFANFYRSIAQKHGRILSQLKDIEKEKAESQLLKYWALIVEENNTHKLILIPKEKAGECKKWLETQIYIQSTNNPKIIWLESLTYRSLRKLCFGFVENGNNEFNQNIKDLLPKDENGYTIKGEFDFKGDEQKKIKFYRRVLSSKYAQQVLDIPAEQIEEDIIDQSFDSLDDFKIALEKICYSRHVVCPSDIVEKLKHYDAQIFEITSLDLKNPENVKEKQDRFEHFDKHHTQIWKNFWTGENEKNNFNIRLNPEITITYRQPKQSRIEKYGEQKSDKKNRYLHPQFTLITTISEHSNSPTKILSFITDEEFKTSVNKFNKNLKKENIKFALGIDNNEVEFSTLGVYFPAFAKTTNEEKIAELKQVKKYGFEVLTINDLNYKETDYNNKERKIIQNPSYFLKKENYMRTFNKSEQDYEKMFAEQFEKKHLLTLDLITAKVICGHIVANGDIHTHFNLQMRDAQRLIYKMNDHTQEETIGRIKDFKIKETEAKNKVYVNIDANFIDGGFKSVFEIRPEFSNIKLKEEILSEIKTFNTRSISNEELDLKINHLKRSIISNAIGVIDFIYKQYKERWGGEGLIVKEGFDTKEVDKGIEKFNGNIYRILERKLYQKFQNYGLVPPIKSLMAVRADGIKGDKKAILRLGNIAFIDPTGTSQECPVCSEGELDHTTTCSKNCGFESNGIMHSNDGIAGFNIAKRGFENFY

SEQ ID NO: 50 - protein, 1122 aa, Unknown
  Metagenome-Derived Sequence
  MISC_FEATURE (1)..(1122): Unk22 Csm1 protein
MSTIITAKQLEALADIYQTRKTIRFNLLPVSLSHKKTSEDEFKIALGQLIENYKQVVNNFNDTVFSCENEIEILNPRIKINCRWLKVYTKQDFYQNALRLKNKNIDLGEADFLLEIFQEWSKRNWSEEVCTEIEKPGILNEIEELKNQPLNCQKRKADFAYWVHQLQTRNNFPFIHELFENINDEMGGENDERIANTKKILDICEGCLKKIDDYLLPSQSLGQEIERASLNYYTINKESKYYENEIKNKEKTLEEPPTSLRFYKDTNFLKNISKDLPFFIESLNKSIPENAKFIASVGDPNKAENWSLAQAYQILKFYKGKQKSNLMEFVSQKPSFSELQKEKGLSLMKKIKDKRRSNEQVFQDFITLAKEIEQLGTEKFRLDINSENYPQQSIALRKKIKETTQKRNKYFIYNFTEYIDFHKGFDEIAKEFGKINADIKGLKKENIDAERLRSWAVILEKNSQHYLMTIPKKDGKLPEAYREIKSLRSESGENLWTLSVFESLTLRALDKLCFKKIDNTFIKSIEKELRGKCPEYFKRGKFMLKSEFKDGQPPAEFYQAILSLETTESVILVNEYLRDEKRDILLEKKFTSLQNFQSEMEKICYIRKEIKISQATKEHLEQKYDADTYQITSYDLEKERQNPEEHTKIWKRFWNQNKKSGYVTRLNPEMIINYVEQRIGSIKDKGEKEVKRNRRKQAEYILALTITENNDKPKTDMALASKDAVKKDIEKFNTERNLILSNDPYSFYYYGIDRGQKELITLGVFGFENQDIAVSGWDKNGSLISKNYKKPRPVTIEAYELPQEKFLEEIEYTVSNGETRSFDAYKNISLCEHLLVRKDVDSCLDLSCAKLIKGKIVVNGDISTYLQIKKTAAMRYITDGLAQHQFTNVLIQEREGTLCLEEEKRGITTLVELYHFDSRFDNLVDRANLKTELQEHFDKIREENSQGDIYTIEKINHLRDAICANAVGIIVHLLQKYPGLITLEDLDIEHKSREFSKYYGDVGSRIEIAFINKLQTLGLVPPSCKMVIGMQSKKEINQLGIIHYVKTDGTSGDCPHCGQRIDKKTKDTNKWGKHQFKCDNNGKSCGFSTYEDKDHKELDFLKNSDDVATYNIAKLGFESIVV

SEQ ID NO: 51 - protein, 1130 aa, Unknown
  Metagenome-Derived Sequence
  MISC_FEATURE (1)..(1130): Unk23 Csm1 protein; Xaa=Gly
MMNNIENKNLYEVRKTVRFELEPQFKFNYENKDIVNNNFDLNNFIDKYSSFLKLFNEIVFNFNXEKLNXKLKIKYSFLKSYTKNQYYDNKIIKPLKLVNQVEIXSSKKFEYLFQTFSELYKNNFDILNNIKELSQRSLENQSRKSDLAVYFSELSKRTNFVFLYELFNNSLNIENDEVSVKIDKANILTKEIDELIKKIKKSLLPTEVIEKLSFNYYTVNKRKKDYDKEIENKINDFSIQLKDFNPILSITHSXFKNYISDIAEKSTLLTIVDXYNLMKKYKAEQKSNFLKYLYSKSRNEDCDLNIDLFSDILIKPEFNEILDLTKAINILSQVKTDILNLKEANDKNKKNFEIESTLEKYNNNFXTDFXKIERDNFFEKITKLKKLRXDYFFEXNKEKFKFNDYKIFCSEYKKVAKEYXNIKAKIKALQKEKIDAEQTQSWALILEENNNKFLLTIPRDNTNNSENLSEANKKIKYLPSDKNXDIYLNIFDSLTLKALDKLCFXKENNTFRRTIYFNKAEYPEFFNDKXFLKDKFEFSNLVNXQKINDEKLLIKFYKSVLALESTKRQISLKFFTXIEDFLQTNFDTLDEFQEELKKVCYTIIRKTITKQTKDEIINNYQTKLYKITSYDLKKYDEDFIKTLKYKSDLKRKKINNHTQIWLDFWEKENKNNKFPTRLNPEIKISFTQLNLKFIQSNSELFTNRHFGNRLILTSSFTQNAFXKDLDLNFKETQDISNFYEKFNNNFNKNIKPTLKYSYXIDRXENELVSLXIFDLSKDKPEEKXVKIPVYELKTDKFFAYTKTTSTGKNMFPYQNVSYYQYEDFPHYYNEIKYVSCLDLSTAKLINNKIYLNXDIQTYLNLKIVSAKRKIYEIISKSQHKSESLDYDDYNTMIYIDXIKGKNKHIYKHNSKYESILSFDFVKDELKKYIIKVKVDLNDNEEVSIQKVNHLREALCANMVXIIDFLQKIYPGMIYFEEKNEDDRINHFNISNSSLGSKIELKLLQKFASKNFVTPVYKQILTIKDNKKYNIKQLXIIXYVDEKNTSDSCPICXSKLFXHXSFEFENLMHHYTEKYXYNYXDSLDKAKKTTYDICDYHMNDKNYXYFFINSXDDLATYNIAKKXIEYLNSKK

SEQ ID NO: 52 - protein, 1166 aa, Unknown
  Metagenome-Derived Sequence
  MISC_FEATURE (1)..(1166): Unk24 Csm1 protein; Xaa=Gly
MENNNMFNNLKNLYELRKTIRFELEPYIIKRNLIPDNNVNENLLKEFYNSYKDFINLLKKNFFNDKNIIXEEDKDIENKPFANLFKKAXINIEXNNQSXNQDIDKDIYDNYEWYNTIQFKYKWLEEVFLNEWIDNKEKIKYKNGEKKQKNYITFXDLXENNFVKKFFIKFFKDTDSNLKSLEQYLNNXLEDQTRRSDILFLIQSINSRDYLXKLYILFKKDNIDHKNDYNIIKEMKESILQLEKLIKQLLNKLKPSQAFXLPIEHISLNYYSVNKTPKEIDDEIKNELNKKNNIDKKYIWTFEDKDNLKSMFFKSTDKELEKELEKELNQEMSLKELKQKIKLFKAKQKAGFLELLQQKTPFKNFTKPFDFKFMGESFEKFNLVLFSKINEDTYNKMLKLTEEIEKENNKAEIKKLKLKRXKFFQRELKQFKGFCDAYKKIAQKYXQANAKIKSLKSQKVDAEKLRXWXFLSQKNNDYFINTFDIENSKNVFTKEIKNLKENXKDVVIYILSSLTLRALDKLCFKKDSSFIKELINNIDDKFINTNNKYKKLKSKKQLLEELEEXELINFYIEILEKQKTLNIKYRTEKSLDILKSSKNLEEFEINLKLETYHFISKKISEETYNRILKEYKXNSYKITSYDIKRXKQTKKYTTWWFDFWKKENKYNKYITRINPEMTISFKEKDKNFIEDNPDKKRNRKFKNRFILATNFSFYADKYYIDSAFINEEKRKNSIDSFNKLFNQNNKLKYIYXLDKXTKELITLXIYEIKXEELKPVNISVKIPLYKITKKXFKYFEEIENKNXEKKKRYLAKNVSYFIKDLENKELFEKLEINSCLXDLTYAKLIKXNIILNADIFTTLNFYKITAKRFLNDAITKXKIEXEKVFYIEKNKNFYYNYENRSEIEKKVIIYRKEEFDYLPYNEQYYNSLIEEIENELNSYIKKIQSSLNNSKKHHDNEDISIQKINNYKNAISANIVXIIIKLQEHFNXYICFETLDEXQIQKKXLKTFIGNIINEKIYNRLQLNLEVPPILKKFRTDVXNKKIIQHGKVIYINESNTSKACPICNKTLLEVDKNXILKEKDGKDDNKIYKLYXHLKRKNENKMRHLSDNEKFQPXKIEINXKIEKICDYNMEKNNYXLDFIKSXDDLATYNIAKKALEYLNSKTNN

SEQ ID NO: 53 - protein, 1167 aa, Unknown
  Metagenome-Derived Sequence
  MISC_FEATURE (1)..(1167): Unk25 Csm1 protein
MENFQIRKSLRFKLESNENNNLINETTNQLSTRQDFDLSNFSTKLDNFLNDLTDYLFYEDKQGDLIIKKYLILKNDWLKTYAKQQFFICKNSKQTRGNQRVQFTIEDCELEDMITEVRENVYDICDELYERSRADLHERYKRSGIAVLLNRLNTKDNLPFLVDLVKLSIDKKETSDLSIRLKSAGEELLNLLKQAIEHFLPEQSSGMCITKASFNYHTINKKPIDFDKEIKNVESSLLTSRQAQERNKGGIDNNVWKTAWIDINIKANGLPLCLGDSPFMEVDSYASLRQILKNILATQKSQFQEAMQRGDSYRELKESDLYLFNNISEDEFNKYFEYTEEIEKLATKRNQTHDYKLKKDLASKIERLKRERGSLISEADRRNTNYFRTYKEFAKFYRKVAQSHGRELAKLLGIEKEKVESQLLGYWAMIIEEKGEHKLALIPRKKTNDLKRRLEESKNSKEEVKLYWFESFTYRSLQKLCFGNLETNTNTFYPELRKDGALLRKFSLQDRNGYPKFISGEHEFKGDELKKIDFYQSVLASDCAKNKLNLPYDEVYNNVVNKQFDNLEDFKIALEQVCYKRCITTNKHLIDNLASEFGAQIFDITSLDLRRESNTKDKAEKYTYKEKRPTELWREFWKEENEEKGFDIRLNPEISIIYRKAKESRIEKYGADSKKNNRYLHDQYTLVMTFNEHCNTPTKNLAFANINDEQKVIEEFNERFKKENIRFALGIDNGEVELSTLGVYFPEFEKESIEEKLAELRNVEKYGFDTLTIKDLTYKETDLKDKDKKIIENVSYFLKEDLYCRTFGKTAKEYKEMFEKVFEKKRLLSLDLSAAKLVCGHIVTNGDVKALYNLWLKHAQRNIYDMNDHSKREGLKKVDFRYSEDLNTEERRIFIAYLNEGNDKYNKLSKEEKNAYVDWLYEAWADNEIENKKFYNVYKEQKIKGDYLHNVLLGATYIGEELQGVEEIANIDHIRHVFKFREDFEKIFTREEIKKAIDSYNKREISNEVLDLNLNKAKSSIVANVIGIVDFLYKYYKNRFGGEGIVVKEGFGISKVEGDRMKFSGNIYRMLERKLYQKFQNYGLVPPVKNITEFRGKDNAFVEFGNICFIDYSGTSQRCPICEKGRLNHTETCSENCGFSSKNIMHSNDGIAGYNIAKKGFREITKK

SEQ ID NO: 54 - protein, 1168 aa, Unknown
  Metagenome-Derived Sequence
  MISC_FEATURE (1)..(1168): Unk26 Csm1 protein
METYKITKTIRFKLEADEENSIHIKEDIINIETNDNEFTMVDFVSNLGNYIKDLKNYLFYEKKDGSLSFKDKIIIKNEWLRQYAKQDFVELKSKKRINLRNNRMEQIKIGDIPRLSSKIEEALDIAKEIYSKLSDDATLEQHERTKKAQIGLLLKRLEAKNVLPLLMDLVKETLDKDETDDLSIRLKRQSQKINSQLKIAIRSFLPEQSNGLQIAKASFNYYTINKKPIDFEKKIEDLKKNLNVKDLEKLNVYFDKKEKKQKNYLGKKIFSLFETDIQKALSKNQPLYLGDAPMIDSAYVSLRQIFKKIKSEQKKQFSELMQNKCSYDELKNSNLYLLNDIGLEQFNTYREKTKELEELATKLSNQNLLENAKERLRSQKEKIAKERGNIMKDRFQTWKSFANFYRTVSQKHGKILAQLKGIEKEQAESQLLKYWALICEKENQHQLWLIPREKAWECKRWLETVNDTSIDNENSIKLYWFESLTYRSLQKLCFGFLENGNNEFNQNIKDLLPKDRIGNTINGEFAFEGDEERKIEFYKTVLNSKYAKQVLNIPFKQVEEEIISQSFENLSDFQIALEKICYRRFAIYSNYIISFDAQIFDITSLDLKNNEKNNLNTHTHIWRDFWKDENEKNNFDIRLNPEITISYRTPKQSRIEKYGEKTKEYDPNKNNRYLHPQFTLITTISERSNSQTKTLSFIEDEDFKKSINEFNKKLKKDNIKFAFGIDNGEVELSTLGVYLPTFEKETHEEKIYELKQIKKYGFEVLTITDLKYKETDYNGNVRKIIQNPSYFLKKENYIRTFSKSEQEYEEMFAKLFKKEHVLSLDLTTAKMICGHIVTNGDVPALFNLWLKHAQRNVFEMNDHTVKETAKTIRLRNNEELTDNEKEKFAEFISDGKKFAKLTKEGKKSRYLKWIFEDRKENSFTEDENKKFNDCQKKKGKYNSHIIFASRFEGDELKSVTPIFDCRHVFKKRKEFETIRPIKEIENEISRFNTNRTSHNISNEELDLKITDAKKALVANAIGVIDFLYKQYKQRFNDEGLIIKEGFDTQKVEEDIEKFSGNIYRILERKLYQKFQNYGLVPPIKNLMAVRNEGIKDKNAILRLGNIAFIDPSGTSQECPVCKEKSKEKHTNNFICECGFNSTNIMHSNDGIAGFNIAKRGFENFINEK

SEQ ID NO: 55 - protein, 1171 aa, Unknown
  Metagenome-Derived Sequence
  MISC_FEATURE (1)..(1171): Unk27 Csm1 protein
METYKITKTIRFKLEAKDENIPEIQKDIAGLDNNFDLANFLTGLNHYINDIDKYLFEKKKNGNSVINGKITIKPDFLKNYAKQEWVNFQEKNKLTQNATQNSRPRKERNSINEFTGLDEKIKQTFKEVADIYETLANDASAGLNERAKREHTGLLLKRLQAKNTLPYLISLAENSNNKNETDDLSIQLKNQSSKLEQQLAAGIREFLPAQSSGLPVAKASFNYYTINKAPIDFIKRIEELKKNLKVDDLQKLNSFFDKKSKKNKLYFHDNLFKLIQTDVQEQLKNNKILLLGDTSMLDIENYISLRQVLKNIKSTQKKKFSEWMQTDKNYDDLKKTELYLFKNISLDQFIDYREKTKELEELAVKINQAANGEERKSLISKKEAVAKIRGNIMKDKFEAWKSFANFYRSIAQKHGRILAQLKGIEKEQTESQLLKYWALVLESNNQHKLVLIPRENSGECKKWLEENDNRSSPGSRHIFWFESFTYRSLQKLCFGNLESGTNTFNKTIQNLLLKYSKGKPINGEFAFEGDEQKKIKFYKDVLQNQTTLNLPQEKVQMEIINKNFASLGDFQIALEKICYRRFIVLNSDAEKILLNKFYAQIFDIISLDLKNLEIINNKQEKYLHNDKRHTQIWKEFWTSKNEENSFDIRLNPEIIITYRQPKQSRIDKYGQNSKLSNRYLHPQFTLITTISEHSNSPTRILSFVTDEEFKNSVDEFNKKLKKDNIKFAFGIDNGEKELSTLVVYLPEFSKRTPEEKIAELKQIEKYGFEVLTINDLNYKESDYNGKERKIIQNPSYFLKKENYMRTFDKSEREYDEMFEKLFKKKRTLTLNLTTAKVICGHIVTNGDVPALFNLWLKHAQRNIFEMNDHIKDETAKRIILKNKLDTNKEKLKFAEYISHKEKFDEFSEVEQEKYVHWIFEDREKLDFTTKENSKFNDCTKRKGDYRTDILFASCFIGDELRSVTDIFDCRHIFKKHDEFYSIKSEKEIAAEIESFNTNRTSHDISNEELDLKIVDAKKALVANAVGVIDFLYKKYKERFNGEGLIVKEGFGTREVEQGIEKFSGNIYRILERKLYQKFQNYGLVPPIKSLMAIRSEGLKGNKKAILQLGNVCFIAPDGTSQNCPICETKMNNNHADEIVCKVCGFESKNIMHSNDEIAGFNIAKRGFENFN

SEQ ID NO: 56 - protein, 1171 aa, Unknown
  Metagenome-Derived Sequence
  MISC_FEATURE (1)..(1171): Unk28 Csm1 protein
MENATIKNPKYSYMKSIRFNLIDTDNKLSDLKSNSNQDSIINLDNIFSSYDKLIKEFKSLFFEVDKNKDYKRNNSENYILKRTIKIKKQWFKTYFKEGWNFKEEKKQEIEKTQTKINETVSKFENLCKQLRTDIDHDKNRAHKKHRNSNFSSILQQIKNKDVFYLLNDLVKQSINKNEVSKVNSLIKDFSSFEKKLNQLSKEYLASQSLGIELYRSSFNYYTLNKSSKHYLKQIEKKIQNYKDEKNKTHIEFQNNSIKVNDMKLQLTSKDLEVMENIKSELKIKFPLNLEESKYFMKLFKAKLKSDLFKDCQKNNEIKDYSCLFNENKKLKKIFDLTREIQNENEFKEIQNLKKDRGEILKSFENWKNFINSYRKISQDYGRIKTNIANYEKEKIDSQKLRYWNLFLKKDNQIYILFVPIEFRQDVKEKITNANTVNSPNKIFMIKSLTKRALHKLCFNEYGSFLNEMKKKKKETYNEIIKFKQKFREEFEQNKIEKLNQELIQELKKKKIKFENDELKRSKNFVGFMKNFENKKYGQFKKQFKEKIEKLNQKYTKQKEEKTTKILKEVLQSDYAKSRLDLKDFDLQKVYLAQTSNEFEEELEKECYKILPYYIDNKLLSELETLFKVFKCKIQSYDLDKRFKNETQTPKSLEKRHTREYWNEFWQKLNQSKIRLNPEIRVNYKEKDNEMERYLWKRYNVDKEKIKENKYGFNRNLQDKYIINFSFLVNTGKKFLDLGFADSNEIKHEIEDFNIDLNKKMKNPFFCGIDIGEVELASSAIYAFDDKHKYQFNNQKFIRPVIPDNLPIKCLRLKKEYYTKSRKPSKQKVNFKKIEERQIISNLSYFSDQEELFDEISPFALNLTCSKVINGVIIENADILTYLQYMKKLAKRRLFEIYSKGFLETDNKKHNFQDLKLDWQYPKESNKYKSNNLILCDKENKIVKAKIFTFIYEYEGIKTKNGEYEFDSMKDYFNKYLNKLKKIKKSNDNKIIKEDIPRINNLRDALVSNMIGVLNLFNKFVDLYVVLENIPNKNKQDEYLIKRLESALFQKFQTFGMVPPNVKNLIKIKKMLQTKEDKDSGKEIQIGNILFINERKTSQTCPYCENSDNNQDHEKGIFLCSKCNFSTNDKEKIHLTELKILKSCDIVAAYNIAKKGYQFIINGTKHKNIKSE

SEQ ID NO: 57 - protein, 1187 aa, Unknown
  Metagenome-Derived Sequence
  MISC_FEATURE (1)..(1187): Unk29 Csm1 protein
MEKYKITKTIRFRLDADNTAISAIVKDTEALEARGQGFKIKKFVNALGRFLSGDGVQKYLYDMSNEENCVFKRNLVIKNTWLKNNAKQEIAGMDLKRGLIIKDIKGLQDKIEEIYDKLWEIYEILYESAYLPLQDLARREGIGLLLKKLSVKNALPFIISFVEESNDKNEADDLSLRLKKQGKEILTQLEIGINEYLPAQSSGLPVAKASFNYYTINKTPVDFGEKIQELEKRLSVDIKKEISSFTGGIKTAIKNKIAGKKILLGDTPMFESENSVSLRQILKNIKSEQKAQFNKFMTTQNNPQLEEMKTMGWYLFGDITEGEFNDYKEQTKEIERVGAKINQCGNIKEKKELRSQLQKLKKKRGELISEAHKKGGNDKNFKTYKEFAKFYRKIAQRHGKILAQIKGIEKEKIDSAMLNYWAAVIELSGRHKLVLIPKKDENAKKCIEWLEDESKHKNGSCKIFWFESFTFRSLQKLCFGNLDSGTNTFNQKIQNLLPCDERGNLMNGEFAFKGDEQEKIKFYKKVLQSQKDINLPQKEVVDNVVGRKFETMDEFKIALEEICYIRRERLSANAESELKSKFNAQIFDITSLDLRNPVNCAGKPEVYHHNDKRHTEIWKEFWSLDNERRNFNIRLNPEITITYRKPKESRILKYGKGTEKYNADMKNRYLYPQYTLLTTISEHCNTPTKILSFMTDNEYEESIKAFNSKLKKEDIKFAFGIDSGETELSTLGVYLPEFSAESTELKDIEKYGFNVLTIKDLNYTETDYNGSDKKIVKNPSYFVDKSLYMRTFKKTEQEYEKMFAEQFEAKKRLSLDLSAAKVICGHIVTNGGVSEHFGLWLKHAQRTIFWMNDHTEKKTAKNIKLKDSSELTYDEREKFAEHISSDEKFKKLDVEEKKRYVRWIFEDRETLNFTEAENKKFGGYQKKKGDYRLGILFASCFIGKELESVTQILDCRHIFKKREEFYSLKSKEDIEAEIKRYNTDYTNHNISTEQLDLKFVNVKNALVANAVGVIDLLYKQYKERLGGEGLIAKEGFDTKKVEEDMEKFSGNIYRILERKLYQKFQNYGLVPPIKNLMAVRADKVEISEAEKSKIRENCKISKIDPENEIIKRNKTLILRLGSIAFVNDADTSQECPACGTKSKEKHVDNFICGCGFNSTGIIHSNDGVAGFNIAKRGFVNLMEHELR

SEQ ID NO: 58 - protein, 1190 aa, Unknown
  Metagenome-Derived Sequence
  MISC_FEATURE (1)..(1190): Unk30 Csm1 protein
MESYKTTKAVRFRLEADDAAAPLVAGEVAALTAVGQGFKIRRFINRLGEFLGEGVQEYLYDAEGKVKDNLAVKNTWLKSNAKREIAGMIAGMKLRRGLAVKDIKGLRESIEKVFNDVWDTYEKLFSSVDLPLHDLAKRAAIGLLLKRLQVKSALPYLISFVEDSSDKNETGDLSLRLKRQAKDILEQLEAGVYEYLPPQSGGLEVARASFNFYTINKKPVDFGKETEKLNNSLIVSAEEKVHRGINVSKEVKSAIVNDILDRSSGKKILLGDAPEHDGEGCVSLRQILKNIKSEQKAAFNEFMTQNPQFEALKGKGWYLFSDITENEFDDYRKQTKEIERVATQKNQCERGDKKKLLQSDLQKLKKQRGALINAANKKGGNENNFKTYKAFADFYRKIAMDHGKILARLKGIERERVESATLKYWAVVAEVNNRHKLVLIPRENAGACRVWLDGGGHRNGAFKIFWFESFTFRSLRKLCFGFVENETKSNTFYDEWKKELTDYRNVSSEIDLNVTPGDRKGYTEEELRQNEQRKIKFYKAVLGSGCAKRSLNIPTEQVRKEIVNREFKNLDEFQIALEKICYLRFATLSANAEAELKKYNAQIFDITSLDLKNPESAAGKAEKYEHSDKRHTKIWKEFWTAENENAGFEIRLNPEIKILYRRPKQSRVNKYGEGTERYNPNRKNRYLRPQYTLVTTISEHSNSPAKEVSFVSEKEYTDLIDEFNGRFKKEDIKFAFGIDNGETELSTLGVYLPAFKKDTKEERLAELSNVEKYGFDVLAIGDLNYKENDCNGKERKIVQNPSYFLNKDLYMRTFNKTEAEYGEMFARQFEEKRLLTLDLTTAKVVCGRIVTNGDVPALLNLWLKHAQRNIFEMNDHIKDKTGKKILLKDKLDTDNEKRKFAGYISHKDEFDKLSGEEKARYVQWIFEDRDSLNFTKGEENKFERCQEKKGDYRSGVLFAASYTGVDLQSVTDIFDCRHVFKRRGEFYSIKPEREIKQEIDSFNTNRTSHAISNEELDLRIVHVKSALAANAVGVIDFLYRQYRERFGGEGLIVKEGFDTKKVEEDMEKFSGNIYRILERRLYRKFQNYGLVPPIKNLMAVRAEGMRADEKNSKPDLGAIVRLGNIGFVNETYTSQECPVCGGNLNHEKVCPKNCGFNDKRFMHSNDGIAGFNIAKRGFENFLNEKHGGAQ

SEQ ID NO: 59 - protein, 1194 aa, Unknown
  Metagenome-Derived Sequence
  MISC_FEATURE (1)..(1194): Unk31 Csm1 protein
MESYKITKAIRFKLEADEKAIPAVMRDISALRKTGDGADIKAFAEELYELLGYIHDYLYDEKNDDDYIFKRGLTVKNTWLRDNAKDETSGQTLKRGLTIGDIKGKDSRGSDLQENIEKIFDEVVDIHERLESAINSPLQSLPRRASIGLLLKGLARKRALPYLISFLEGSDDKDEKSSVSLIAKKRAKIVTDGLERCIRHYLPAQSHGLPVAKASFNYYTVNKKEIDYKGTIEKLKKDLKVGSLKEDLNRIFDNLKASISKEVKTELLNDISSRLSNGSELFLGYAPAAGIENGNYLRQILKNIKSEQKAAFNEFMTQNPSIGAIKDKKLYLFSDISEGEFNAYKKLTAGIGDAAAKINQARNDGDKQRLRSELNKRKKERGELINAANRRNGNENNFKTYKAFAEVYRKIAQRHGKILAQLKGIERERIEYDMLKYWAVIIELGGRHKLVLIPEKRAEECKKWLETSDESNRKNGSVCWFESFTLRSLKKLCFGNLDSGSNLFNSTIRPLLPKDRRGEAMNGDFAFAKSAAERMPEASEQDILKEAESEKIKFYKNVLKGQKALNNLPEEEIQTEIVKKDFNSLEAFQIALEKICYRVFYSLSANAEQELKDKHGAQIFEITSLDLKNPENVKDKQEKYAHADKRHTRIWKDFWTAGNEKGRFDTRLNPEITITYREPKQSRVDKYGKGSANYDAGKKNRYLHPQFTLTATVSEHSNSPAKTLSFMTDKEFKESVDDFNKKFKKDDIKFALGIDNGETELSTLGVYLPAFGKGAATEEKIAELKQIEKHGFKVLTVKDLNYKETDRNGKERKIVQNPSYFLSKENYTRTFKKSAEEYEKMLAGVFEEKRILTLDLTTAKVICGHIVTNGDVPALYGLWLKHAQRTVFEMNDHGKAKTAKDIKIKPKLDTDKEKLKFAEHISKIKEFRGLTAEEKAKYVKWIFEDRKPGDFTDKEAETFSDCLKKKGDYRSGIVFASCYVGEELKSVTEILNCRHIFKKREEFYSIDSEEEITAKLEGYNTDRTSHNISNEELDLKITDAKRALVANAVGVVDFLYKYYKQNSGGEGLVVKEAFDAKKVEEDIEKFSGNIYRILERKLYQKFQNYGLVPPIKSLLAVRGEKEELRLGNVSFVKEEGTSQRCPVCGAKSDEKHTDRLKCQKCGFDSYGIMHRNDGIAGFNIAKRGFENFMKEERK

SEQ ID NO: 60 - protein, 1209 aa, Unknown
  Metagenome-Derived Sequence
  MISC_FEATURE (1)..(1209): Unk32 Csm1 protein; Xaa=Gly
MLESFKDLYEVRKTVRFELKPSKVLPKIKIKNIDENFINEFFSNYNKLLEIYEKVFFNNREINGKIKFSFSFLKTNLKKEYYELXIDKIKKSASVNKIKLEKIDNYEKLNSSFLSTLKKQNEYVNSFKEKIESPYENRSRKSELVLLIYNLKKRNNFPFIENAFNNVTAENIMVDDEIKKXNMLAKTISNQLVTIEEELLPQNSMXLVIERATFNYFTINKTPIDYDIAIKNKKNKYNEIIXKQNKLKNTYKKQSINEFIKYIIEDGFSKFENQIYEQNGKYIDTGRKXSSFNELTIENAYTLMKKYKSDQKTAFYEIIKKEKYNFLKSQNNKITITYNKDSFNDKKEEITVKLFNDISKXNFDKIAMLTKKIETLAELKNYLEKKEFNKFQEKINTLQEIININFNNDNEEEVENLVKRLNADRVLLKKERXTYFDKESNNFAFTKYKEFCEVYQEVAMTLXKAKADIKSLEKEKIQSLFLKSWALIVENKEKNQFHLLTIPKKNISKARNIILALKNXENNNNILYLFESLTLRALKKLCFXKEFSENRGDYTEKSSPFRKSIEENITNSDFDNINFYIEKQKKDGNNYRVLKQYYDFYINKEENKELDEELLIKFYKSVLQLPSTLEQIIIKNFPDYESFISKEFNNLEEFEEGIKRTFYIKQPLKIEEHKLNKLIKEYNWNLYKITNYNLIKNDLDEIKELKEKERFNRNHIKNHSKLWWNFWEKENIDNKYPIRINPEIAISFVKKDDNFYEENHNKLFKNRRFQDRFLLTTSMTEFATNKSIYLSYKELSELKNFYNSYNYNFSENFKXEYIYXIDRXDNELASLXLFRNINKNIEAVKIETYKLKNENLLFKEXTSNTPAYKNISNYIEKDELFEIKEVSCIDLTLAKLIKXKIVLNXDISTYINLKITAAKRSLYNIFSKXNYKEXDIIEKXKFKDKNTGEEXYDXTLKFNQKEIYKNNSEIEKIISIDKVKNILEEYIEEIKQNIYNEDISIEKINHLRDSICSNMIGIINFLQEKYSXYMFLENKKIIDSNKNFLKDXYQLGTRFEQKLLQKFSNLNLVPSNYKLFLSIRDEDKEIKQLXIIRYIDENSTSSACPVCNPKLYNVNSDDINKLYXHXKXEEKEKSMHHINDKNDENHQEXKWESXKLESXDLCDFHIXYNEKYPDFSFIKSXDDLATYNIAKKALEYLEYLKSLNNDETK

SEQ ID NO: 61 - protein, 1257 aa, Unknown
  Metagenome-Derived Sequence
  MISC_FEATURE (1)..(1257): Unk33 Csm1 protein
MDADKTTKAINEYQTQKTIRFGLTATNQNLYSEEIMKLLNISEERIIKEKVKVNNDTDKTNQLRGCLVQIKKYLKTWENIYAQIDFLAITKDYYKVISKKARFDFDKGNGSEIKLSSLQSTHNKKKRYQYIIDFWKENLRKTENLYRKSDDLLKIFEEAKNQNRDDKKLNKVELRKTFLNLFTLVNESLKPLIEGNLFIVNDDKIDEKNSKHNYVFYFISKTEERRLLYDNICTLQDYFKNNGGYVPFGRVTLNKWTALQKFNNRDIEINRIIKELKINNISTQKTDYKYNDFTENFKEKKDENGKVVKNSAGNIIWDLKANAKSVIEICQFFKYKKVPINARLNLAKRLIKDNKLKKEQENTFLSEFGVLKTPAFDYARDKENFNLTNYPLKVAFDYAWENCAKDKYEKIPFPKEQCERYLQTAFEIDATKDENKKLIDTHLNKYADLLQFKILLERFKAEFHKTNEETNKNNIQKLRNVFSGLDYHGDNRLNKNQIQKAIEAWFDNKEQNIGKKKENEKLLTENEKNNFSLSMQIIGQERGGLKNGIPKYKELTEMFKVCASKFGKQFADLRDYFNEAYEVDKIKYRAWIIEDDKKNRFVLFVNKEKAFDLTSEEGDLWFYEVKSLTSKSLVKFIKNRGAYPDFHDVKNSFHYSSIKKDWQNYKNDPEFLDKLKECLKNSKIAKDQKWAKFCWDFKQCDTYEKLEKEVDRKGYKLEGCKSEPKTISLTQLTDWVENKDCFLLPIVNQDINKGDKRTKNQNQFTKDWFDIFENKKRLHPEFNIFYRFPTKDYPNTKFKNGTEKTKRYSRFQMLAYFGCEVIPSGNHLSKKEQIAIFNNDKKQKEEVEKYNKSISSDCDYVIGIDRGIKQLATLCVLDKNGVIQGDFQIFTRTFNKQTKQWEHKELEQRNILDLSNLRVETTITGKKVLVDLSKIKDDEGNYTNLKQTIKLKQLAYIRELQYAMQTRPDDLLDFVKSINSANDITAENIKHFISPYKEGKNYDDLPKVEMFNLLKEWGNADENGKRKIAELDPADNLKSGIVANMVGVVAFLCENYNYKVRIALEDLTRAYGIQKDALNGTAIYQNDEDFKEQENRRLAGVGTMQFFEVQLLRKLFKIQVDKNLHLIPAFRSVDNYEKIVRRDKQNSGDEFVNYPFGIVCFVDPKYTSQQCPYCNNTHKHKKNDTETGKKAFYRNKGENKNSLLCEKCGVSTIEGEETLSSKNDNKKQFNIHYITDGDQNGAYHIANKVVINFQKDS

SEQ ID NO: 62 - protein, 1276 aa, Unknown
  Metagenome-Derived Sequence
  MISC_FEATURE (1)..(1276): Unk34 Csm1 protein
MEKIKNKYQVSKTLRFGLTQKEKRRKKGFVGEVYESHTELKDLTDFSVKKIRAEIKQGGNSGIPIEKIRQCLIVIRRYMNFWENIYYRCDQLSLDKDFYKKLSKKIGFEGFWHEENRKTDHRIKKPQARTIQLSELNKKDDHYKERKDYIVEFWESNINKAAERFKETESVFEKFEIAINANRDDNRPNEVEMRKMFLSLANIIYETLVPLCNGSISFPNIEKMQNNEENNNLRKFAADDEFRAGLLTQIEELKAYFEENGGNVHYCRATLNPKTVIKNPNSTDSSIADEVEKTGIERYLQNKQEIKNKIEKIKDKNLPLIERALLFKYKTVPAGVQFDLAKFLSVKLGKTEQELRTIIRCIGQIQSPAEDYAKSEDKKGFHLEQYPLKSAFDFAWESLAKAIYHKNVDFPQQQCKVFLEKNFDIKIDSNANFKLYAQLLYLRENLATLEHSKPTDPDTFEKNIRKLLDEINWSTIDKEKGSVYKNAISDWLKNKKAKDEKFGKVKQSIGLSRGRLKNKIKKFDDLTKDYKDIATQLGNAFAAMRDKITNAAELNKISHYATIIEDKNGDRYILLQKVTENEKPVGENWNKNGELKTYLVNSVTSAAISKMIRKIRTDELRKNEKMQSSITKLNEKQKEEKNINDWKNFIEEKRWDLEFKLDLKSKNFEQIKKEIDTKCYLFNTGYASQADIKQLVKEKDALLLPIINQDLASKDKIVRNQFSKDWQMIFSDNSQGYRLTPEFRISYRQPTSNYPQPEEKRYSRFQMIAHFLIDYIPQNNQYISTREQVELFKDETKQREAIEEFHKQLTPKTEAEQKAESLSALAAKFNNPNNKKQKNNASENKPDEKFYVFGIDRGQNELATLCVINQDKKIIGDFEIYIRKFNSEKKQWEHLKLENRHILDLSNLRVETTIVIDGKPEKKRVLVDLSEIKVKDKNGEYKNPDKMQTKMRHLAYIRKVQFQIQNNPEGVLDFLKKFKTKNETIYNLVDKENGEKGLISFYGAGNTNEDLPKDDIWKILQKFQELKNKTGDDNVKKEIKELIELEPVDNLKNGVVANMVGVIAYLLEKFDYQVYIALEDLTKPFNEDIKDGTTGVKGNYKGEGKRADVEKYAGLGLYNFFEMQLLKKLFRIQQENDNVLHLVPAFRAVKNYENLIAGKGKIKNQFGIVYFVDANSTSKTCPVCSSIPDKNNSNNKNAKGKKIINKKGNESVIWVERDKSNGNDIIRCYACGFDTTKNYSENPLKYIKSGDDNAAFIISTLGIKAYELAKTLVANK

SEQ ID NO: 63 - protein, 1276 aa, Unknown
  Metagenome-Derived Sequence
  MISC_FEATURE (1)..(1276): Unk35 Csm1 protein
MKSFENSCQISKTLRFGATLKEDKKKCKSHEELQEFVDISYKTMKSSATIAESLNEIELVKKCERCYSEIIKFHEAWGQIYCRTDQIAVYKDFYRQLARKARFDVGDQNSQLITLSSLSSKHNVYQGLKRSQHITNYWKDNIARQKSFLKDFSQQLHQYKRALENSDKAHTKPNLINFNKTFSILANLVNEIVIPLSNGAISFPNISKLEDGEESRHLIEFALNDYSDLVGSIGELKDAIATNGGYTPFAKVTLNHYTAEQKPHVFKNDIDAKIRELKLIELVEKLKNKTSKQIEEYFSKFDKFKIYDDRNQSVIIRTQCFKYKPIPFLVKHELAKYIAEDEDAVLKVLDAIGATRSPAHDYAHNEDVFDLKHYPIKVAFDYAWEQLANGVYTTVSFPEEKCREYLNAIYGCEVTKEPVFKFYADLLYIRKNLAVLEHKNNLPSNPEEFICKIENTFEKIVLPYKIKEFETYKKAILTWINDGRGHEKYTDSKRELGLIRGGLKGRIGAQKMFRKNKKGELIPYYENPYTKLTNEFKNISSSYGKTFAELRDKFKEKSEITKITHFGIIIEDNNKDRYLLANGLQHDNTDQSNTQVEAILGKLNTSLEFTTYQVKSLTSKILIKLIKNHTTSPNAKSPYADFHTSKIHVDWTKIKKEWDTYKSNHSLLQYVKDCLTNSTMAKNQNWAEFGWDLESCNSYEAIEHEIDQKSYILQKHTISKASIKSLVENGCLLLPIVNQDITSQGRKDKNQFSKDWKQIFEDSKEYRLHPEFAVSYRTPIKDYPKDKRYGRLQFICAFNCEIIPQNGEFINLKKQIENFNDEDIQKNNVAEFNNKVNEALLGKEYVVIGIDRGLKQLATLCVLNKRGKILGDFEIYKKEFVRTENRSKNYWKHTLAETRHILDLSNLRVETTVEDNKVLVDQSLTLVKKNRDTPDEKATEENRQKIKLKQLSYIRKLQYAMQTNEQAVLDLLKDNSDDEEFKKRVEGVISPFGEGQEYADLPIDTMRAMIQDLQGVIAKGNKQTEKNKIIELDAADSLKQGVVANMIGVVNFILAKFNYEAYVSLEDLSRAYNVAKSGYDGRYLPSTSQDPDMDFKEQQNQMLAGLGTYQFFEIQLLKKLQKIQSNNTVLRFVPAFRSADNYRNIIKLNPKYDNTEYVHKPFGIVHFIDPKDTSSKCPVCGKTGKKNVDRNEKKNNILLCKACGFRTVWELKQPENIKSEGYCFSEDEIQKTIKNNQKQMEIKKLSDKNIHYIHNGDDNGAYHIALKSVENLKHKE

SEQ ID NO: 64 - protein, 1297 aa, Unknown
  Metagenome-Derived Sequence
  MISC_FEATURE (1)..(1297): Unk36 Csm1 protein
MKSIVNNYQISKTLRFGLTQKTKIQKEGYNGEIYVSHRELCDLVKISEERIKKSVSASDKSNLELSIDIIDTCLKQIGVFLSDWQQVYYRKDQVALDKDYYKILCKKIEFDGFWKDDRGQRMPNSRIINISELDKRDSLGVERLHYILNYWKDNLVSASQKYSAVEEKIKRFKSAIKINRTDNKPDEVELRKMFLSLANIVCDTLQPLCYGQISFPKINKLDDSRTDNKKLIKFATEYKSKNDLLTSIAEQKKYFEENGGNVPFCRATLNPKTAIKDPNSTDNSIKGEIAQLGLDSILKSFKSYLFFENSLENMSAKEKIDLMKSDGASIIKKGLMFKYKPIPVIVHREVAQELSEDLNKTEESLSDFLRGIGQAKSPAKDYEELTDKNEFNIEAYPIKVAFDFAWESLAKAKYHSEIDLPVDSCKKFLKTFDVTPDDANFLLYAQLQELNALISTLEYGYPSDEQSIVKKIKALSNEIQWEKVSDRNGQEYKRSISDWADGKRDSDGFKIAKQNIGLFRGGLRNKIDKYYSLTQIYKKTVMDEGKIFAIMRDKIIGAAEQNKVTYYAAIIEDNTGDKYVLLQELPLNGQDRIYDKMTRDGDGYVCCFVNSITSRTIAKQLRKKRMAELKKNKAWGAYNDNVSNTQQPVLSDEEKEERNIREWKSFISEKRWDCEFNLNFKGKNFEEIKKEIDAKGYELENRRLSREALDELVKNNKCLLLPIVNQDIIKENKTESNQFTKDWNSIFDDNSPWRLTPEFRVSYRKPTPDYPVSSKGDKRYSRFQMIAHFLCDYIPNSDSYVSVREQIENYKDDKKQETAVKDFHNRLLGKTEEQKIIDRLGAFQGWGNVIIKKTKPEKQEGSKEKFFVFGIDRGQNELATLCVIDQDKKIQGGFKIYTRSFNSEKKQWEHKFLEERNILDLSNLRVETTIVIDGQEKKEKVLVDLSEVKVKDHFGNYVKPNKMQVKLQRLAYIRKLQFQMQTNPERVLEWYSHNQTNDLIINNFVDKQNGEKGLVPFFGAAVAELKDTLPIDRISEMLKQFVELKNLEKQGEEVKSKIDQLIELEPADNLKSGVVANMVGVIAFLLEKYSYQVYISLEDLSKPFENQIVLGISGVPIGINKGMAGRSVNVEKFAGLGLYNFFEIQLLKKLFRIQRDSCHILHLVPAFRAMKNYDNVAVGKGKIKNQFGIVFFVDAAATSKTCPCCGANNSKKFEPDFRKFPNAKKFETPDKKSVWLERDKSDGKDIIRCHVCGFDTSKEYDDNPRKYIKSGDDNAAYLISAEGVKAYELATTLVDNK

SEQ ID NO: 65 - protein, 1315 aa, Unknown
  Metagenome-Derived Sequence
  MISC_FEATURE (1)..(1315): Unk37 Csm1 protein; Xaa=Gly
MINLENFKNLYEVRKTVRFXLNQPNKKXDFKTHLEFKDFTEKSFQNVENELASNGKYNIGDEEQLIKKISAFVEQLKIQLXYWKVFYQRYDLIAINKDYYKILARKAKFDAIWEISKSNKYIKVKQPQASQISLSSLKIXNRSDSIIQYWXEIIEKTDYLLNIFKPKLEQYERAIKDANNAHIKPDSINFRKTFLQLLKLTKEFLQPLSDRSIIFEFSKKKVSKEIEKISEFAXEKNNTKIYNVLKNXEELRQYFEANXSQVSYXRVSLNYYTAVQKPNNFDQEIKKSIDDLXIINFLKKSDSQIIDYLHQGSKQKIKLLLTSKHPYPIELLQLFKVKPIPFSVKYNLAKFVEKNYKSETNLSYEDILNKFNLLXRAIDIANDFKNSNHKGNFSLDEYPVKLAFDYAWENTARSLKRDISFPKKVCERFLKDNFDIDVDNADFKLYANLLFIADNLATIEYNNPNNEAELINEIKQAFECMSFSFEKKVYEXHKKAILELLDKEKSQRDYSTISKAKQELXLLRXXLKNKIKKYRDLTQRLIDKKNSHFXIASFIGKTLATIRDGLKEENELNKISHYGVIIEDNNQDKYILISKLEGKDRRDKIVQKLXKXDIKVYQVNSFTSKALNKFIKNPLSEDAKKFHGKYKDEYGFXYENKNXDFTYKVKNVSEYDEQGKWIXYQEEFLNHIKKCLIDSEISREQNWTAFGWSFDGCNNYEEIEKEIDSKXYQLTENSISKGNLESLVKDEDCSLFPIINQDISSQKQENKNIFTLDFEKVFERKECRIHPEFSIFYRKPIEEHKKENKSXIINRFGRLQLLANLGIEFVPRNLSFKTKKEQNRIAIDQKKQNQLVQEFNQEKVNTYFEGLDNYYIFGIDRXIKQLATLCVTDKGXVIQDFTIFTKHFNQASKIWEYRENRKEXILDLTNLKIESDKNXNTYIVDISLFDAKDDNXRSTGTNKQNIQLKQLAYIRKLQYQMSANEKXVLDFIAKYISKDEREQNIKELITPYKEXKKFADLPMDIFQEMFENYYRLKTDQNLSEFEKKNLMKITTELDASENLKKXVVANMIGVIYYLMKYYDYKVKITLENLNQSFXXQVDXINNHYVDIKNNFMYQENQALAXVXTYHFFEMQLLKKIFKISTEEXILHLVPSFGSVKNYFKDIEKYSLIVNIXRNEKYNQFXVVHFVKPDNTSKKCPVCLNTQTTXKKEXMPIINRNYKKSNIFYCERCXFQSIHSHCQEENIKDSNDFHYSVEEVERIEMKNKEAIEKYKKQXKNLHFIKNGDDNAAYNIXEKIRELPKKSDVKNTSISXNISFS

SEQ ID NO: 66 - protein, 1276 aa, Unknown
  Metagenome-Derived Sequence
  MISC_FEATURE (1)..(1276): Unk38 Csm1 protein
MKSFENSCQISKTLRFGATLKEDKKKCKSHEELQEFVDISYKTMKSSATIAESLNEIELVKKCERCYSEIIKFHEAWGQIYCRTDQIAVYKDFYRQLARKARFDVGDQNSQLITLSSLSSKHNVYQGLKRSQHITNYWKDNIARQKSFLKDFSQQLHQYKRALENSDKAHTKPNLINFNKTFSILANLVNEIVIPLSNGAISFPNISKLEDGEESRHLIEFALNDYSDLVGSIGELKDAIATNGGYTPFAKVTLNHYTAEQKPHVFKNDIDAKIRELKLIELVEKLKNKTSKQIEEYFSKFDKFKIYDDRNQSVIIRTQCFKYKPIPFLVKHELAKYIAEDEDAVLKVLDAIGATRSPAHDYAHNEDVFDLKHYPIKVAFDYAWEQLANGVYTTVSFPEEKCREYLNAIYGCEVTKEPVFKFYADLLYIRKNLAVLEHKNNLPSNPEEFICKIENTFEKIVLPYKIKEFETYKKAILTWINDGRGHEKYTDSKRELGLIRGGLKGRIGAQKMFRKNKKGELIPYYENPYTKLTNEFKNISSSYGKTFAELRDKFKEKSEITKITHFGIIIEDNNKDRYLLANGLQHDNTDQSNTQVEAILGKLNTSLEFTTYQVKSLTSKILIKLIKNHTTSPNAKSPYADFHTSKIHVDWTKIKKEWDTYKSNHSLLQYVKDCLTNSTMAKNQNWAEFGWDLESCNSYEAIEHEIDQKSYILQKHTISKASIKSLVENGCLLLPIVNQDITSQGRKDKNQFSKDWKQIFEDSKEYRLHPEFAVSYRTPIKDYPKDKRYGRLQFICAFNCEIIPQNGEFINLKKQIENFNDEDIQKNNVAEFNNKVNEALLGKEYVVIGIDRGLKQLATLCVLNKRGKILGDFEIYKKEFVRTENRSKNYWKHTLAETRHILDLSNLRVETTVEDNKVLVDQSLTLVKKNRDTPDEKATEENRQKIKLKQLSYIRKLQYAMQTNEQAVLDLLKDNSDDEEFKKRVEGVISPFGEGQEYADLPIDTMRAMIQDLQGVIAKGNKQTEKNKIIELDAADSLKQGVVANMIGVVNFILAKFNYEAYVSLEDLSRAYNVAKSGYDGRYLPSTSQDPDMDFKEQQNQMLAGLGTYQFFEIQLLKKLQKIQSNNTVLRFVPAFRSADNYRNIIKLNPKYDNTEYVHKPFGIVHFIDPKDTSSKCPVCGKTGKKNVDRNEKKNNILLCKACAFRTVWEFKQPENIKNEKHCFSEDGIKKTAEDNNKKIKEKNLSDKNLHYIHNGDDNGAYHIALKSVENLKHKK

SEQ ID NO: 67 - protein, 1171 aa, Unknown
  Metagenome-Derived Sequence
  MISC_FEATURE (1)..(1171): Unk39 Csm1 protein
MNNIKTTKAIRFKLENSASNREIQERIDNLSSNNGFDLVSFVTELNNYIDLLNGYLFCSRGDRFYLNDKFILKKEWMKNYAKQEFAEFKTKIDNTANGVRVQYTVGDYRVESKIQAAFDNIDEIYGELCDDASRELNERSKRTRTALLLKRLYAKNNLPLLIDFVENSTYKKEVGNDSLVLKSMGKRLMEHLELGIQEYLPEQSAGVSIAKASFNYYTINKKPIDYDAKIEEIEKKLVVSNIDRTWNDRDNKIKNNGRLWNIVKADIASRQNNKPLCIGDSPFMDVDEYASLRQIMKNILSEQKAAFNELMQQGGSYKELQNTDLYLFKDITKDEFDKYSELTEDIEELATKRNQTKNEQKKKELKSQIERLSKQRGSFISEADKTTEKMFKTYKAFSVLYKKIAQKHGKELAKLKGIEKEKAESQTLQYWAMILEKDNRHKLVLVPKAKANECRSRLVEADNANGVIKLYWFESFTYRSLQKLCFGNIENGSNTFYPQIRRDRELGRKYSSLDRNGYPKFISGEHEFAGDEQRKIQFYQDVLRTDYARKNLNLPYGKVEERIINSTFESLDDFKIALESICYRRAVCTNIHLIDALESEYGAQIFDITSLDLRREDNIKDKEEKYSYSYKSHTAVWKEFWTAENEKRNFDIRLNPEISIIYRKAKESRIEKYGVDSKKNNRYLHDQLTLVTTLSEHCNSPERNIAFATIDEEERIIAEFNSKLDKGNIRFAFGIDNGEVELSTLGVYLPEFKQKSIESSLTEVNNVDKYGFDTLTIRNLMHSEKDVNGRDRRIIDNPSYFLKEDLYCRTFGKNGEEYKAMFDKVFEQRRLLTLDLSTAKVICGRIVTNGDVISLYNLWMRHAQRNIYDMNEHIEGGGAKVYLKKSEVLNDNEKRKFLDYLNDGNERYERLSDAEKKDYINWIYKIWDGVEVENDRFAEVRRKQKRPGFYFHNVLLAASYIGEEVQDVKDIANIDDVRHVFKFREDFKQFKQEKEILDEINKYNIKVISNEELDLRLNQLKSSLVANVIGVIDYLYKQYKERFGGEGIIAKEGFGIEKVESDRMKFSGNIYRMLERKLYQKFQNYGMVPPIKNLTAFRSKDKSYTQIGYICFIDYDGTSQRCPICNAKLAYNHGLECSEKCGFDSEGIMHSNDGIAGYNIAKKGFESIVNK

SEQ ID NO: 68 - protein, 1165 aa, Unknown
  Metagenome-Derived Sequence
  MISC_FEATURE (1)..(1165): Unk40 Csm1 protein
MNDWQNLYAVRKTINFEFKPSLYTKKRVLDARIKRNSVLIDVKNNTIEIIHLFNTQNQEVANLVQRYLQKLTSDFDILVEKFKNITDGIYINGRYENFRIYVETSKLKLVGKDFRDCYFQMKNERGKSRKGWDYYYQFNAKTNKAEFRHVKFGDFLTVSHLFAFHYDKTTKDGEFQRLLKEKINFFIKKYKCIQIELSDFLDDNNRFEKFISKPEILDRLKRLAYCIGDILSLMNIFCDKGKNGSDGCSVFIKDLGDFRIIALDNDYESVVAEIIRQVNCITNPKAFHFKFTLNFKAKNPNTQLSGNDVFFNEKDLQKKLKEEMDKLENNKKEKSECQSFLSKFDNLAGKDCTDGRWADIKNKQGLPDNYQDAKKEYESCEGKKKELSKEIAYNENEKNNYAVINQLKAAISNSKNTHFGVVIEKEANYYLALENKISNGKLKADNKYVLNNLKNNLFSCKLLKYESLTWKAVEKLCLLPTSSLNGTSKDVVGYWSKFCKGVIILEKKNEKDKRDVFDLGIIKNYLVEIMSKTNISSGFNKEDFDKLVTLDGIKAYFDDYCFENQWIDADWDEFLGLDREGSIDLYQIFNKDFELDEHFAISENDKERIKRIKFAQLILKERFVAKQKNSERIRNLFTIYWQNCFNKFDTEKFRVQPEGRIYIRDMSPVNDAKRYREEKVLGDFGILFNPVAKAIDQSSKDVKDRIGNFNDYLKKQPLKNEIYVVGLDRGENSLVSYTLVKFRKKIVGENDISVRFDSLIGTEAWVLDEMVEVRDLSAVKIFNEKGKWRKSEFVEQKEDYYFVEKNEGNYDEDKNKQDACKKRDELKKMYPDYGDGRERVVVCPIRCKPQTKKEKQQVEMEKTGAYAVKILSWEDEDGAVYNYRVAQEILKEERLSQVEKNRDFELFNTEKFKNGYVSALIGFIGERVETNNAYVSLENLNMGDKTGKGGNYRKTFGASVYQMIENRLMSKLGYSVVKGSSSVHSQKVPKIRKVEELKKDVLSGEKNNKDFQIGVIQITDETNTSQICPNCGYSMNRYGLAKIENGELKLTLNAEELKDKDFGIDISKVTIFRVDDGVFAWRYSGVATEKLDKSHNDFCRVLSKTRQNETKSKDFIRCVHCGFDSRFPTKNHEKLKKVNGGDVLAAYNIAKRGLEFIQCKSEVIN

SEQ ID NO: 69 - protein, 1342 aa, Unknown
  Metagenome-Derived Sequence
  MISC_FEATURE (1)..(1342): Unk41 Csm1 protein
MLTKFANLYELTKTVRFGLTPKNSYKKVSDFFELTEKSLESVQAEIVEREKEKINITSTEESIKKIRAYVDELKKQSAQWKTIYQREDMIAVTKEYYKKLEKEAGFDGFWEDRGKKQPQTSEIMLSALSKEYNNKPRREYIITYWALLLQKTEQLNSYFEPLLEKYEESLSRKEQAHLKPNLVDFRKQFLSLLNVSNKWLMPVINQSIVFPKIHNASKGEQNRKVKDFISEEGRQKRIQLQSIGRSLRDFFEANGSRVPFGKATLNYFTARQKPNRFDSEIDALMLDLEIEEIVRKVKDLNGEELKNYFKYQTYATGDKLDAFLGHSYMTLIEKIQLFKPKPIPASVRFSLAERLSKKMNLPMEKVTAIFDEIGNPIDIAREYEQALDQKNFDLNKYPINIAFDYAWESCASLIKGRISEGDFPKAQCLAILKKFNADGDDFKLYANLRYIRDELAPIEHNNPSADIEKELVYNIQKTIGIIYSSMPSEYQKYLDIILKWVEMPKIERNSSDSNFIFAKQKIGLLRGGLKNKINKHAEITNKFKNLSMAFGRSCSDLRDKLREEHELSKIKYYSVLIEDSKKNRHLLMLPLETGDQKMSAVEIENRLDILENKFVEDAPSANAYIASKVSSFTSKALVKMLKNPKGSEDFHIGSEKYKLHDYNNKIKKEWKIYQDDSKFLSYAKKCLSESKMAMNQHWEKFGWNFEGCKTYADLEKEVDIKGYSLEKKYISFENTEMLVYEQGCLLFPIVNQDYASEVCQNIFTGNKNAFTIEIEKGLQEQDGYLIHPEFTIFYQKPTEDYKKSNRYGRFQLSANFSLEVKKISDNFKTKKEKLKNIRDKDSFQKDVQIFNESINAQLRINEDVYFYGIDRGINELATLCLLNNKNKIQDFIVFKKEKKKRNSENHLREAGDFYTYVDFEKQNILDLTNIKVETWNMRDEIHPNSNFLKQAFKKIEADPEMKMIATQLGYGINEKKQCTILVEYPSDRSNTLKLRMNHFQRALQFATSHSEKRDIVGGIAERNFEGTDLENPSDEVKKQIIQDLFGLGSDFLIDEKKAGVINELQTKKFRFEKIYSRNQQLFLEMFEPLIQQLIEWYQHKNDPDYEKTGKAKYEEMEDLDTLKRGVTANMVGVFSFLMQKFPGVIVLENIAKEKLEKPVQSKLDEHTREVESHQEAEHHRWAGVELYRYMEKKLVQKFSNWRQPTGEIFNLTPPFANLESLNKQTMTINSERIENMFQFGIFCYTPAEYTTKTCPCCNKYHIRNRKKGNTFDSIICKNEHCGFDTRYNEPLHESFNPARNVEIALRLNPEFSEALPKIRSGDQSAAFNIAKKGLIIMENKLC

SEQ ID NO: 70 - DNA, 3477 bp, Unknown
  Metagenome-Derived Sequence
  misc_feature (1)..(3477): Unk1 Csm1 gene
atggaaaattttaaaaatttgtatgaggtgcgaaagacagttagatttgagttaaaaccgagtagaaaaaaaacttttgcaggaggagacatctttgaattgcagaaagattttgaagaagttcaaaaattttttttggatatttttgtttttgcgattgaacaagaaaaattatatcaggaggaggaagaagaaggaaaattgtcccgatatacaaaaatagaatttaagaaaaaaagagaaataaaatatacatggctgagaatttatacaaaaaatgaattttatgattggaatggaaaaaatgataaagaaaaaaattacgctttaagtaagatagattttttggaaaaagaaattttaagatggtttaatgagtggcaagaattaacagtaaatttgaaaaatttaacacaaacaaaagaacatgaaaaagaaagaaaaagcgatattgcctttgtattgagaaattttttaaagagacagaactttccgtttataaaagatttttttaatgctgttattgatattcaggaaaaacaaggcaatgaaagtgatgagaaaattagaaaatttagagaagaactaagggaaatgaaaaaaaatctcaatacttgtgctaaagaatatctttcatctcaaagtaagggagtgcttttgcataaggcaagtttcaattattatacgctgaacaaaacaccaaaagagtatgagaatttaaaattgcaaaaagagttagaaattgataatattttacctaaaaaaatctgcaagagagttcgttggaataaggaaaagaaacaggaggatattttatttgaatgtaattctgactggttggtagaaattaaacttgggtacgatattcagaaatggactttagatgaagcttatcagaaaatgaagacttggaaggcagatcagaagtcggattttaatgaaaaaattggaaattttattgatcaatatttaaagaaaggatttattgaagatttgatgaatgaaaatgagaaaaaaaacgcagaagcaatattaagagaattttctgttttcaaacctatcgaaaatttttatttttatgattttttagagagaacaaaagaaataaaaatattaagcaatcaaaaaaataatatccttcaaaaatacaataaaaacgcaaaatattttgagaaaataatcacatacaaaataaaggataaagaagatctgacggaagatgaaaaagaatatcaagagttagagaaaagtatagaaaaaaaagcaaaagaacgaggaaaattttttaatgcaccgaaagaaaaagttcaaacacaacattattttgaactatgtgaactttataaacgcattgcaatgaaacgaggaaaaataattgcagaaataaaaggaatagaaaatgaagaagttcaatctcagcttcttactcattgggctttaattgccgaagaaggagaaaaaaaatctgtcgtgtttatcccaaggaaaaatggagaagaattagaaaaccacaaaaaagctcatgaatttttgcaaaaacaagaaaaaaaagaatttggcgatataaaaagttatcatttcaaatctcttaccttgagagctttggagaagctttgttttaaggaaactgaaaatacatttaccccagaaattaaaaaagaaacgaatccaaaagtttggtttccaaaatataaacaagagtggaatgacgaaccgcaaaaacttattaatttttataaacaagttttgcaatcaaaatattcgcaaaaatatttagatttggtagcttttggagatctaaaatcatttttagaaacttcttttgatgatttgcaaatatttgaatcggggcttgaaaaaacttgttatataaaagtgccgatttatttttccaaagaaggatttgaaacttttacaaatagatttgatgctgaagtttttgaaataacaactcgcagtatttcaagtgaaagcaaaagaaaagaaaacgctcatgcagaaatttggaaagatttttggagtaaggaaaatgaagaaaaaaatcacattactcgtctaaatccagaagtaagtgttttttatcgtgatgaaatagaaaaaaagagcaatgctttgcgaggaaataataaatcaaatataaataacaggttttctgcttctcgttttactcttgtaacaacaatcaccattagagcaacgcataaaaaatcaaaccttgcttttaaaacagaggaagatataaaaagccatattgataagttcaacgaagcatttcaaaatttttctggtgaatgggtttatggaattgacaggggactcaaagaactggcgactttgaatgttgtaaaattttctgatgaaaaaaatgaatttggtgttataaagccaaaagagtttgcgaaaattcctgtttacaaattgaaagacgagaaagcaatcctcaaagatgaaaatggaaaagacttaaaaaatgcaaaaggggaagccagaaaagtaattgataatatttcagaagttttggaagagaaaaaagagcctgattcaaatctttttgaaaaacagggagttttatctcaaggaatttcatgtatagatcttacacaagcaaagcttataaaagggcatattattctgaatggtgatcaaaaaacatatctcaagctaaaagaaatatcagctaaacgaagaatttttgagcttttttcaacttctaaaattgataaaaattctgagttaagggttgagaaaactactatcagtattaattccgaagatggaaagagagacttttattggttaacaaaaaatcagatagttaatagtgagacaaaaaaagaaatacaaaaagagcaacaagaaaaattagataatttaaaagtaatctttatagattacctagaaggtttatgtgtaaaaaataaatttgaagacatagaaacaatagaaaaaataaatcatttgcgagatgcgattactgcaaatatggtagggattttgtttcatttgcaaaaagaattcaaaggaattatagctttagaaaacttggatactgtgcgagagcaaagcaataaaaaaatgattgatgagcattttgaacaaagcaatgaagatatttctcgtcgcttggagtgggcgttgtatcgtaagtttgcaaatatgggagaagtgccatcacaaataaaagagtcaatttttttacgagatgaatttaaagtgtatcaaatgggacttttgaagtttgtggaagtaagtggtacaagttcaaattgtccaaattgcgataaagaagtaggaaaaactaatagtcattttgtgtgcaaaggagaaaataattgtgggtttagctcaaaagaaaatagaaatttacttgaacaaaatcttaataattctgacgaagtcgccgcttacaacatcgccaaacgaggcttaaaattaatcaaccaaaaatggaacaatacatccaaatctcaaaactaa

SEQ ID NO: 71 - DNA, 3873 bp, Unknown
  Metagenome-Derived Sequence
  misc_feature (1)..(3873): Unk2 Csm1 gene
atgaacagcatcaagaatgaatatcaactctcaaaaactctgcgttttgggttgacaaaaaagaagaaactattaaaagacgattgtaatgaaataatttatgaaagccatacagaattaaaagagttagtactcatttcagaaaaaaaaattatggaatctgtttatatcaatcaaaaagcaaaactagatttgtcagttgatcaaatagatacgtgtctttcttcaattaaaaattttattgattcatggaaaggcatatatccaagagcagaccaaatagctattgataaagactattacaaaattctatgtaagaaaataacgtttgatggcttttggatagatgaaaagactaaaacaaaaaaacctcaatcacgcactatcttactttctgaacttagcaaaaaagatgcttcaggtaaagaaagaaagcaacatatcttagactattggaagaataatattttttctgcaatagagaaatatgaagttgtgagtagggaactaaaacaatttcaaaaagccttaaagatacaaagaacagacaataaacctaatgaggttgaactaagaaaattatttttatcacttgcaaatattattcttgatattctaaaaccacttgtaaatggtcaaatttgtttcccaaaaattgagaaattagacatttcaaaaaccgataataagaatctaattgactttgcaacaaaccacaaatttcaaagtgatttacttaacgaaattgcagaattacaacattactttgaagaaaatggaagcaatgtgccattttgcagagcaagtctaaatccaaaaactataataaaatcaaagctatcaacagataataacattgataaggaaataaaacaattaggacttgatagaattttaaatgaatatctatctgctccgtactttgataattctattatacatttgtcagctaaagaaaaactcaataaaatagaagataagaaagaaaattatattactcgtggtttgttgttcaaatataagccaattcaaataatgctacatcatgagattgcaaaaacattaagtaaagagattggtaagagcgaggaaaatataatagaattcttgggcaatattggtcaaataaaaagtccagcaaaggattatgaagtgagtaaagaagattttaatataaataattatccgcttaaagttgcttttgattttgcatgggagaatgtagcaagaaatttataccatacggatactcatgctcctattgatgagtgtagaaaattcttagcagataattttgatattaaaatagaggataacaatttaaagttgtatgcaaatttgctggaattaaatgctttattgtcaaccttaaaatatggaaagccaaaagatgagacaagcatcaaacaaaatataaaagatctactaaacaaaatttcatggaatgaaattggtaaaagtggtcaaaaaaataaaacaaatattgaaaattggcttaataataaagacaaaatagacaatcaaaatggaatagaaaatgctaaaaagcagataggtttgtttagaggatccttaaaaaataaagtacctaaatattataaactcacagaaacctacaaagatatttccatgaaaatgggaaaaatatttgctacaatgcgtgataaaataactgatgaagcagaactaaacaaagtttctcattatgcaatgattgttgaagatgacaataaagacaaatatatcttattacaagaatttacagacaagaaggaggagtgtatttattctaaaacgcaaacacacaatagtgattttacgacttattctgtcaattcaataacttcaagtgccattgcaaaaatgattcgtaaagtaaaagctgaagagctaagaaagaatcaatataataaagatactttctcaattgaagaaacaaaagaagaaaaagaaaatcgaatcattaaagaatggaaacaattcttaaaagataagcaatgggactatgaatttaacctggacacaaagaataaaaactttgaagaactaaaaaaagaaatagattccaaatgctataaattaaatatatcctatattgacaaaaaaacaattactgatttggtagaaaacaaaaattgtcttttgttacctattattaaccaagacttgtcaaaagaagaaaaaacacaaaacaatcaattcacaaaggattgggatgctattttctcacaaaatacaccttggagattgactccggaatttagaatttcttatcgtaagcctacacctaattatcctatttctgataaaggagataaacgttattctcgttttcaaatgattggacattttctttgtgattatattccacaaagcaacacgtatatctctaatagagaacaaatagctaattataaagataatgaaaagcaggaacaagctgtccaatgtttccatgataaattattaggcaagacagaaaaagaagcaaaaaatgagaaacttattgctttgcaagcaaaatttggttctataagtagaacaaacataacacaagaaaagaaaaaggagaaattttatgtttttggcattgaccgaggacaaaaagagttggcaacactttgtgtgattgatcaagataagaaaatcatagacgactttgatatttacacccgttcatttaattctaaaacaaaacaatgggatcataccttcttagaaaaacgtgccataatggatttatcaaatttgagagtcgaaacaacaataagcattgatggtaaaacagaaaagaaaaaggttttggttgatttgagtaaagtaaaagtaaaagataaacaagggcattattcaaagccagataagatgcaaataaaaatgcagcaacttgcttatattcgcaaactgcaatttcaaatacaaaccaatccagatgtcgtacttgcttggtattctgataataatactcaagatttaatattagagaactttgtcagaaaagacgacaatgacaacaaaggtcttgtgtctttttatggagcagcagtagaagaattgaaagatacattacccattgaagaaattttgaatatgttaaagcaattcaaggaactaaaagagaaagaaaaagctggtgagaatgtaaaatatgaaatagatagattgatacaattggaacctgtggataacttaaaaactggtgtcgttgctaatatggttggtgtaatagcctttttgttagagaaattcaattatcaagtatatatatcacttgaagatttatcccagccatttgataataaaataaatggtggtattactggtgtacctataaaaacaaataaagagtcaggaagaatggctgatgttgaaaaatatgccggattaggattatataacttctttgaaatgcagttgcttaaaaaactatttcgtattcaacaaaaaagcacaactattttacatttagtccctgcatttagagctcagaaaaattacgatcatgtaacagttggacaagataatataaaggggcaatttggtattgtattctttgtaaatgcaaatgccacatctaagacatgtcctatttgtggtgcaaataacagcgaaaaacctgacaaaaataaatatcctaatgctcataaagaattagcaaaagatggaaaagaagtatggatagaaagggataaatcaaatggcaacgacataataagatgttttgtttgtggttttgatacaacaaaaacatacgaagataatccggctaaattcataaaaagcggtgatgacaacgcagcttatttgatttcagtatcagcaattaaagcctatgagttagcaacaatattagctatagaaaaatataaataa

SEQ ID NO: 72 - DNA, 3276 bp, Unknown
  Metagenome-Derived Sequences
  misc_feature (1)..(3276): Unk3 Csm1 gene
atggcaggtaccccatatactggacatgtagcatgcaaatactgcaaaattacatcgtgggcaacatacgacagaattaaaattaacaaaatcaacatgaatcagagtttcatcaatggacaaaatttttatgagttgagaaaaacgatccggtttgtccttgaccctaaaacattgaaaagaccatacaccccgtcctcagatgaggttaatttggaagaacagctcaataactttattgaaaaatatcaacaaggcatcaacgactttaaatatatagtttactttggaccaaaaaccgccgagacgaaggaactcaataaaaaaatctctatcaaacactcatggcttaggaattacaccaagagtgaattttatagtattaaagataaattgattcagcttgattataatggtaataaggcgtcaattggcaatagcaacctaaagtttttgaatgagtattttgaaaactggattagcgaaaatcaagaatgcgctgacgctctaaaaaattgcattaatgcgcccgcagaaaaacagaagcggaaatcagaagctgctcattgggtaagaaaactgactaagcgaagcaattttgaatgtatctttgaacttttcaatggaaacatcgatcacaaaaatagcaatgatgatatcgaaaagatcaagcattgtttaaatgaatgtaaaacgcttctgacttccttggaaaagatgcttttgccgagtcaatctcttggaatggaaattgaacgagccagtttaaattactacacgattaataaaaaaccaaagaattacgatgaagatattgcccaaaaagccagtgcgcttaatgaagcctaccagtttaaagcagatgataaagcctttttaaacagggttggatttagtgatgatggagtaccgataaatgagcttaaagaagcaatgaaaaaattcaaagcagaccagaaatccaaattctatgaatttgttaatcaaaaaaaaagctattcagatttgaaaaaaaacgatgatttaaaattattaaacgacatttctgaagaagattttaataaattcaaagaaacacaagataaaatgacccgcgggaaacattttcagttttcattcccaaattacaaaaaatctgaaaagaatttttgtgatttatataaaaatgtcgcagtagcttttggtaaaatcagagctgatataaaagcacttgaaaaagaaagaatggatgcggaaaagctgcaatgctgggcggtaattctggaaaaggataatcagcggtatgttgtaaccattccgcgagatgcgaataacaacctcacaaacaccaagcaatacattgataatcttcaaaatgaagaaaatgaccaatggatactatatgcatttgagtctctgactttgagatcgctggataaactttgttttggtttggataaaaatacgtttatccctgcaattaccggagaattatatcaaaagaataattcgttctttgagaaaggccttttgaagagaaaagaccagttttctcaaaacgggacggatttagctgcattctataaaacagtacttgaattggattctacaaagaaaatgctgggaattaataaatacgcggattttaaggcttttatatccaaggaatataccgcattagaagattttgaaaagacactgaaagaaacttgttactttaaaaaaagggtttttatctcagaagacacaaaaaataaactgataaatgactatcagggtaatctttataaaatcacaagttacgacctggaaaaagatgattccgaagcgctgggaacactaataaataaaaaacaatttaatagagcaagtccagaaatacacaccaagacatggctggatttttggacagccgataacgaaactgacaaatatccaatacgactgaatcctgaatttaagattagttttgtagaaaagcaggacaaagacttgaatatgagaaatttgggcctgttaaataaaaaccgaaggttaaaaagtcaattcctgctttcaacaaccattacactgttggcgcatgagaaaaatgccgatttgcattttaaaaaaacagatgaaatacaaacgtttattaacagctacaatcaggaattcaataaaaaaatcaaaccttttgatatttactattatggtttggacagaggacaaaaagagcttttaactcttggcctttttaagttttccgaaaacgaaaaagtatcattcacaaaacaggacggaacagtgggagaatacagcaaaccgaaattcattcctctggatgtctatcaaattagagaaggacaatatttgacaaaaaacaagaaagggcgattagcttataaaagtatcgatcaatttatagatgatgagaaagtaatagaaaaattacccgtcaattcctgtctggatttatcttgtgccaaattagtgaaaggcaaaattattcaaaatggtgatgttgcaacctatcttgaattaaaacgcgtcagtgctttgcgaaaaatttacgaaaacacaaccagaggccagttcaaaacggacagaattggttttaataaagacaaggggtgtttgttcttggatattgaaaataggggaaaattggagaacaacaatctttatttttatgataaccgttttgcggaaattttatcactggattcaataataaaagaattgcaagattattacaatgaagtcaaaaacaagcaaaatatcgaatttatttcaatcgataaaattaaccatttaagagatgccctgtgcgcaaatgctgttggcattcttgctcatttgcaaaaaacacattttggagtaatcgtttttgaagggttggatgcacgtcataagaataaagaaacaactgaatttgcaggtaatcttgccagtagaattgagcggaagattttgcaaaagttggagacactttccttgattcctccgcaacacagacagatcattgatttacaaaactcaaagcaaataaagcagaccggggctgttttatatattgaagagaagggaacaagtgccaattgtccgcattgcgaaaccgcaaatcccgacaaatcagaaaagtggcttgctcataattataaatgcaaaaattccaactgtaattttgatgcaagtgaaatatctaaaagaaaagacctcataggattggataattccgacagcgtcgctacctacaacattgcaaaaagaggccttttggaaatgaatcaaaagatagaacagtctaaagtttaa

SEQ ID NO: 73 - DNA, 3327 bp, Unknown
  Metagenome-Derived Sequence
  misc_feature (1)..(3327): Unk4 Csm1 gene
atggaaaagtttaaaatcacaagaacgattcgttttaaagcaaacccaattagtattaataaacttcaagaccaaacaaagtcattaagtgaaaattccgaagcagatattgttggcattattaataatgctaatcaaattattaatgacttagaggggttaatttttactaatgaagaaaagaataatcttcggaaagatgttacaattcattttcgctggattagacagtatgtcaaaaatgattggtatgcctggaaggaaaaacaaactaataattcaaaacaagcagaaaaaggtaaaagtaaatctgccgaaaaagatcaattgaaatctcctttagcgcaattagctttattaagagataaatttccggatgcccacaaaacatcaaaaacaatccaatcatcaagtccaaatagtaacaaggaaagctcagaaaaaaaacttcctttaggcgatgtacctttcttaaaagaggaatttactttcttctgcaattattggagagaaattgcagaaaagcttaatgaggcctattcaagagaggaacacaatagaatgcgcagggcagatatcgccaaacacttaaatgaattatctaaaagacaaatactgcctttcctttcagattttttggcgaatggcaatgataagaaaaacgatgaaaaaataaagaacttgattgttaaggtaattgaatttaaaaaggacttggaaattgcaaaaaatgcctatctctccgcccagagtagcggcattatgttggctcgtgctagttttaattattatacactaaacaagaagcctaaagatttcgattcagaagagaggagaattatagaaaatatgaatgctaagtattaccagccaggtaatatacctcaaataataaaagatttaaagatagatggtagcttgtctattgaaaagctttatgaggaattaaagagctataaagctgaacagaaagcaaaatttcaggaagctatttcgcagggattaaaatttgaagagttacaagctaaatttccattgtttgaaacgacacaagaaatattcaatgattatgtctcaaagactaatttaataacacaaaaagcaactcaaaaaaataatactcctaagggtagtatggaatttaaacggttgcaagatgagatcaacaagttaaaaagagaaagggggaaaatgttgcaacaaggcaagtttagaaattttaaagctttgaatgaagaatttaaaagggttgcagtaaaaaaaggaaaattaaaagcgcagctaaaaggaattgaaaaagaaagaatagattctcagagattgcaatattgggctctaattggacaagaagaaaataaatacaaattgattctcattcccaaagaaaatgtatcaaaagcctacacagaaatagtaaatcaaaggtggatagatgacagagtctctatgtatttatattattttgaatcctttactttcagggctttgcgaaaactatgctttggtgtaaatggaaacacttttatgccagaaatcaaaaatgaacttccaaaatacaatcaacaggattttggcgagcatatttttaaaacggaagatgggaaaggagatgaaaaggcattggttgaattttatcagcaagttttaaaaacagattttgttttaaaaaatttagccttacctcatcagcaaatggaagaagtaactactactacatttaaagatttgaattcttttaaaattgctttggaaaaaatatgctacaacaaaaaaatggtagcaagccctcgagtattacggaatcttgagcttagttatggtgctgaaatatttgaattaagtagccaggatttattaaaagaacattctacgaatctgaaaaaccacactaaaatatggaacttgttttggagcaaagaaaatgaagaaaagaattttgatacaagattaaatccggaaattggtattttttggcgtgagccaaaagcatcgagaattgaaaaatatggagagggcacagcccattatgacccacagaaaaagaatcgttacctccatccacaatttaccattgctttcagtattaatgaaaatgcattaagcaatgatttgaattatgcttttgaaggttttgaaaaacagaaagaagcaatgatggagttcaatcaaaaaattaataaggaatttaaagatggtatggaacaaaaaaaattaggagcttttggtgtagatacaggtgaagccgaattggctactattggcttgactgataacggtaaaccttttccggtaaaagtgttgaaggttaaatcagataaactaaattattccaaacagggatattttaaagatggcgcaatgagagagaaaccatacaaagccattgataatttaagctactaccttaaaaaagatttgtatgataaaacctttagagatgatcattttgaacagacttttagggaaatatttgaagaaattgaaaccgaaactattgatttaacatcatctaaacttatatgtgaacatatagttgtcaatggagatttacatactcgaagtaaattaaatattctcaatgcgaaacggcaaatcagacaagccttaattaccaatcctaatttagaaattaaatttgaggataataaaattctcatttctgaaacagatgaagaaaggaaaaagataaatccctggaaagccgtctatcataccaatgaagaattagaacaaatcaaatactttgaagcggtaaaagaagaaatagaacagtatttgaaaaaagtgcaggatgattctgctgaagtcttacaaaatattaatcgttttagagaagtggcagcaggaaatatgacaggggttatttttcatctgtacaacaaataccctattcttatagctattgaaaacttggcacaaggcacaatcgaaaaacatagattgcgttacgagggtgtcatggacagaccattggaaagagcattatataggaaattccaatccataggtttaactcctccggtttcggacctaatagctattcgagataatcttactcaaaagaaaaaagataaaatgagccagcttggtgtcttgcaatttgtagatgaacagaataccagtaaaacttgccctcattgtgaaaaaaatgcttacgaaggagaaagaaaaaatctttacctcgaagaaaaaaagaaaggaattttctcttgtgggcattgtggctatcaaaatataaataacccaatgggattgagtttacacagtaatgacgctgttgcagcttttaacatcgccaaaagaggcattaaaaacttaaaaaaatga

SEQ ID NO: 74 - DNA, 3342 bp, Unknown
  Metagenome-Derived Sequence
  misc_feature (1)..(3342): Unk5 Csm1 gene
atggcgggatttgataagttgaaaaatcaatatgaagtcaaaagaacaattcgcttcaatttgactcctgtacatttctcatataaaaaaataagctctgaatcttttgagagcaagctcaaagaatttgtttccgtatatggagatgtaatagattcttttaaaagaatgatgttcatagaagaatacggggaaatctcattaaatagagatattcatgttcgtcatgaatggatgaaaatttatgctaaacaggatttccatttaaataaagaaataatagtcagatatagaaaaaatagaaaaggtgaaaatattaaatcaaatactgatacgtctttagaaaaaacaccttttatatttgatttatttaacaaattcttgatggataatctttcatctgatgattacaaagatggaatacttagtaatttggaggtaataataagagaaccgcttgatgaaaagagtggaaagagcaatctatcatatttactcaataaaattcagaaaagaagtaattttgagttcatttatcagttattcaagaacatgcagagtaaaaaaagtgattttgaaatagaagaatgtaagaaaaagttagacagatgtaaggagctattattatctcttaaccattatttaactcctaaaaattcatcagggttggaagtggagaggactagtcttaattattttactgtaaataaaaagccgaaagattataagggagaaaagaaaagaatatatgataaaaaaaatattcctattaataatagagttctaaacgggaatcaatcaaaatataatgaagtattgaaagaatcaggattttataatagatataataaaaaaaatttctcagattttagtcttgaagaattttataaaaatttaaaggaatttaaggcagaagagaaatctaaattttttgaattaataaattttggtgcatctttaaatagaataaatgaagatatcccactatttgagttatctgatatagaaagaggtaagaataaagaattatcttttgatagtttccaaaaagagactgaaaaaattaagaaattgtctgatgatttaaatggacaattaaatgatactttgaaaaaagaaattaaagaattaaaaattaaaaggggtcgattttttaatgtgaatgatgatgaaaactgtccattccagagatacataacctatacaaagttatatagggatgttgcaatggagtacggacgaattaaagctgatacaaaaaatttggaaaaagaggaaattaatgctgaaagacttgcatcttggtctgtctttgtgaagatagagaatggatatttcttaatgacaataccaaaacataaagacaatcattcttctctctcatctgcatattatgatttaaaggacactaaaagcgtggatggagagtataatatatatataacagaatctctaaccttaagagcattagaaaaattatgttttggattagataagaatacttttgtaaatgaagattttcttgaagagttaaatatgttatctcctgaatatattgttcataaagatggcaagaagagtataaaaagaaaagatgaaatattaaaggaaagcgaattaaaattaattaatttctataagaaagttttgtcgatgataacaacaaaaaaaagaatacttataaatgatttcaaagataattcatgcaaggataattatttatcaggtgatattaaaactcttcgagattttcagattgcattagaaaaaaaatgttttacaagaaaagaggtaagagtatcgaaagattttttgaatgattttagaaataaatatagtgcaaaattgtacaaaataacaagctttgatttggagaaaagaagagaaaatcccgaatcacatacaaatctgtgggagatttattggacacaatcgaatgaaggtggttatacaacaagaataaatccagaaatgagaattaattttatagacaagagggaggaaagtatcaaagacaaaagtggaaatgaggtggaaagaaatagaagaaaggataaagaatttattctttcattaacaatcactgaacataatgataaaccaaagtttgatatggctttcgcagacaaaaagaaagtaattaaaaatattaatgattttaacacaacacttaattccaaattacaagacggcaaactgggaatttactattacggattggatcggggtgaagcagaattagtgactcttggtgcatttaagtttctagatgaaattgtaaaagtagatacaggttgtttgtataacaaacctaaagctgtgaagattgatgtttgggaactgcctgaggataaattaatggaacaagttccatatgagacaaaaagtgggacgatgtattttgatgcatataaaaacatttcaaaatgtgaacatttgttgataaaaaaagagactgaatcttgtatggatttatcgtgtgcaaaagtcattaatgggaaaatagtattgaacggcgatatatccactctaattaatcttaaactagaaaatgcaaagaggagaattaataatcatctttatgattttatgaaagccaaatacaaaaaagatggtaaggtagatattagaattgagtacaaggaaaaaacgaaaaacaagccagaacgatttgacttatatataaataatggagaattcaaggagcttggaatttattatccgaagtttgcaatagagaaaaaaattgcaatgacgcaactcgatcaatatatagtcgaattaagagatataattaataaccagaaaagtgttggattaaatattgaacttgaaaaagttaatcacctccgtgatgcaataagttccaatatcgtaggcatattaaatttcttatataaggatttccctggatttatatcgctggaaaatctcgaaactgatgataaaaatgagaagcttggaaaaagcaaagtgaatttggcgagtagaattgaatataaattacttaataaattcaaaacattaggactcgttccaccaaactataaaatggttatgagcttacaaagtaaaagagatatctctcaattagggatattgaactacattgagacctctggaacaagtagtaattgtcctcattgtgggcaatcaattaatgacaaggagagagaagaaaataagtggaggaatcatcaatttagatgtagccattgtggatttagcagttatgagaatgaagatcataaaggattagatttccttaattcatcagacgacatcgccgcctacaatatcgctaaaagagggcttgaatatataaatagtctaaaaaaataa

SEQ ID NO: 75 - DNA, 3768 bp, Unknown
  Metagenome-Derived Sequence
  misc_feature (1)..(3768): Unk6 Csm1 gene
atgaatcatatctataataactatcaagtatcaaaaactcttcgttttggattgacacaaaaacaaaaaatcagaagacctggttatacaggtgaattgtatgaaagtcataaagtcctaaaagaattggttaaaatttcagaagaaaaagttaaaaacttgatagtccctgcaaaaaatgaagaattactatcttctttagattctgttaagtggactcttacagaaatacgagagtttttagatcaatggcggtatatatataacaaatcaaaccaaatagccttagacaaaagctattacttaattctatccaaaaagttaggatttaatgatgaaaaaaaatctcgagtgattaaaatgatagaaataaaggatgatataaaagaaaaaatcattaattattgggcttttaacttaaatgaatcgaatcaaaaacttttgatggtaaatgaaatggtcaatacacagttaaaagcattagaaataaatagaactgaccataaaatcaatgaaattgaactaaggaaagctttacaatctcttttcaatacagtcttagacattttgaaacctctggtttacagagaaatttcatttataaatttagaaaaaatagaaaaagattctaagaattctttgctagaaaaatttgccactgattttcaaagaaaaatcgatttattagaaaagattagatcgttaaagacacattttagtgaaaatggagggaatgtatctttttgtagggcaacttttaacccaaaaacagcgattaaaaaccctaagtcaaatgataatagtatcttaaaagaaataaagaaacttggaataaaagatattttagaaaacaatgaaaatgttttttattttgaaaaaaagcttgctgaaattacagcgaaagaaaaattagaatatataataaaagatagtgaatcctttttgattcgctcacttttatttaaatatatttctattcctgcttttttacaccatggaattgcaactgaattagctcccattatttctaaagaaaaaaacgatttaataaactttatgatttcaatagggcaaataaaaagtccagcaaaagattatgctgatataccaaataaaaatgatttcaatgtaaatgcttaccccattaaagttgcttttgattatgcttgggaaaccgtagctaaaagccagtatcatcatgacataaatgctcctgtttcaatgtgtaaaacttttttagatgaaaacttcgaaaactgtacaaaaacaaagtattttactttatattctgaccttttagaacttcatactctattatcgaccttagattatggaaatccttcaatggaagactctataatagataaagcaaataaaataattgctaaaatcgacaataaagaacacaaaacaaaagataaagatttagataaagatatagataaatataaagagactattaaaaacagattaaatcataaaaattttaacgataaacaacgctatagtgatgcaaaaaaagagctctctcaatttcgtggtaaactaaaaaatgaaaacgatatttatagaaaattaacagagtcctataaaaaaatagctatgaatactggaaaaatatttgccgaaatgagagataaaataagcaatgcaagtgaacaaaacaagataagccaccacgctttaattatagaagatcataataaggatagatatttgtttttacaagaattcactacagacaaagaaaagcaaatagaatcaatatgtaatgatcaggctgggcaatatattgtttattgggttaattcaatcacctctaaaagtatttcaaaaatgttaagtaaaaaacgaatagagaaattaaagcaaaagaaaattataaataattctataaaaacctccatcctcagtgatgcagaaaaagaagctcgggatataaaagaatgggtgtccttcataaaagagaagggatgggacattgactttaatttagatttacagaataaaaatctagaagaaataaaaaaagaagtcgatgcaaaagcttataaattaaaagaaacacttattagtcagaaaactctatccaatttagtaaaagagggtaattgtttactcttccctattattaataaagatctagtaaaaaaagtaaaaacagaaaaaaatcaattcactaaagattggaattctatttttaagaaggataatctgtggcgcttgactccagagtttagagtttcataccgacaagctacacctggatatcctacatcagatattggaactaaacggtactctaggtttcaaatgacagctcattttttatgtgatttcttgccccaaggaactaaatatatttccaatcgagaacagattgaaaactacaagtcatcagaaaaacaaaaagaagcggtcgaaatttttcaccaacaaattgaaaatgataacaataatgttattagcacacaaagtctaaaccatttggctagacattttggcagtaaaaacattaaaaagaaacataatactatagaaaaaaaattctatgtctttggtattgatagagggcaaaaggagcttgcaactctttgcatcatagatcaagataaaaaaatagaaggaccttttaaaatttatactcgaagttttaatacaaaaacaaagcaatgggagcaccagttttatgaagaaaggtatatcttggatatatctaatctaagagtcgaaaccagtatttctatagatggaaaaccagaccaacaaaaaatacttgtcgatttaagttactataaagaaggagaaaagtttatcaagcttccaaaaatgcaagtcaaactgcaacaattagcttatattcgaaaacttcaatatcaaatgcaaagaaatccggagacggttcttgactggagctataaaaatacagacgataaatctatattagaaaactttgtagataaaccaaacggtgaaaaaggccttgtttctttttatggggcagctgttatagaacttaaagataccctacctcttagtgaaattaaggatatgctcgaaagatttaaagagttaaaaggaaaagaaaaaaatggagaagatgtttcacaacaattaaatgaactcacacaattaaaatctgtagaccactccaagtatggtgtcgtagccaatatggtaggtgtaatagcccatcttttagaaagatatgactataaagcttatatttcattagaagatttaactaaaccttacagtgctattgacggtatcactggacaaaaaaccgacgctaaatcgataagtggcaaacaacaagatgttgaaaaatatgccggtcttggattatacaacttctttgagatacagttactcaaaaaactttttagaattcaaaaagacagccagaacacattgcacttagtccctgcttttagagccacaaaaaactatgaaaatctcatcgctggtgaagataaagttaaaaatcgatttggaattgtctattttgtagacccaaagtcaacttcaataatgtgccctagttgcggaaaaactaataatagtagtaacaaagaaaaaagggttgtacgagacaaaaaaaacggaaatgacataatatactgtgaattctgtggatttgacaccagaaacgattacaaagagaacccactcaaatttataaaaagtggcgatgataacgctgcatatataatatcaacacacacagccaaaaaagcttacgaattagctaaatctattttataa

SEQ ID NO: 76 - DNA, 3768 bp, Unknown
  Metagenome-Derived Sequence
  misc_feature (1)..(3768): Unk7 Csm1 gene
atgagcttagcagcatttaccaatcagtatcaactcagtaagacacttaggtttggttttacacaaaaagagaaagtaagaaaagaaaattttgatggttcgatttatcaaagccatgcggcgcttagagagcttaccattgaatctgagagattaattaagggaaaacttaaatccaataccgatacggcgcttccattagaaaaaataagagcttgtattgaagagataaaacgttatacagacacatggagtaaaatcttcacccgcgacgatcagctcgctctttcaaaagaatactatcgcgtgatggctcgaaaagcccggttcgatgctttttggaaaaattatcgtgatgtaaagcaacctcaaagtcaaattgtcaggctttcttccttaaagagtaagtataatggaaaagaacgtaaagcctatttggtcgattactgggctggtaacctgcaaaccgtcaagcaaaggcttgttgactttgaacccgcaatccgacaatttgaaagtgctctaaaggacaaccgaacggatcgtaagctcaatgaagtggacttcagaaagatgttcctctctatatgcaaattggtcaatgaaacattagtgccactttgtaattcatctctttgtgttcccgacttggaaaaactgttggataatgaagctagccaagaacttcgtgatttcgtaatgatggatatctttcagttgcaggaacagattgaggcgctgaagatatattttggagagaacgggggctacgttccatacggcagaactacgctgaataaatacactgcactgcaaaaacctcatgcttttgacgaagagatagaggcaattttagtaaagcttaaattgtcagatgtcattaataacttaatcaaacaggatgatgtttctgattattttgaaaatgtaaaagacaagattgggcaactatctaacagtagtatgtccgtaatagagtgcgtacagctgttcaagtataagccgatacctgtgtctgttcggtattcgttagtggagtactttcatcgtaaacttggtatagataaggatgaactcggaaccctcttagacaccatagggaagccgaaaagcccagcaaaggattatgctgacttgcaagacaaaggcgatttcaatctctacaaatatccactaaaggtggcgtttgattttacgtgggaaagcctggcaaaagcacaatatcatgaggggctgaattttcccgaggtacaatgtcaaaaatttttagaaaatattttttttgtcaatacttcatgtgaagcttttaagacttacgccctattgctacatttgcgaggattgctcgccaaacttgatcatgaagagcctaatgacagggaggctatcatagacaaagcaatcagtcttatgaatgaagatgcttttccgaaagtacctttacgtgggacaaaaggcgattctgcaaaccaagcgatactttcctggcttcaattatcgaaagaggagcaagtctacaaaaaagagaaaaaagaccagagttataaccaatacgaaaaagctaagaacaaaatcgggctactacgtggtgaacagaagaataagattggtaagtatagagaagttacggaacaatttaaagacttagcgtccaattttggaaaactttttggagcacttcgtgagaaattccaggcgaaaaatgaattaaataaaatcacccattacggtacgattatagaagacaacaaccaagaccggtatgttttattgtatcccttaagtgaagggataatcgatttggataaacttttcgtacatgaggagtcaggaacgttaacgtcgtattatgtcaaatcccttacatcgaaaaccttaaacaagctcataaaaaataaaggtggttttaaagattttcatatggatggccaacagcctgattgggaaagagtgaagaaaaggtggtctgtgtataaagatgataaagcattcttgaaatatgttaagcgatgcctcaacgaatccgaaatggccaaagctcaaaattggggtgaatttggttgggatttttcatcctgcgatagttttgaagaaattgaaagagaggttgataaaaaagggtatagctttaagaatgatcgcaaactatccgaagatacggtcaaacgtctagttaaagaggagaaatgtcttttgcttcccatcattaatcaagatatcattgttgaagaaaccaaattgcgcaatcaattttcgaaagattgggtaaatatttttgatgccgactgcactgaatatcgcctacatcctgaatttgggatgtcatatcgtatgcctacaccaaattatccgaaaccggagcaaaagcgatactccaggtttcagatgatcggttattttcagtgcgaaattgtccctataaaaacagaatacttgtcgaagaaagaacagatcgagatctttaatgatgcagatgcccaaaaagaggccgtcgaaaaatttaatgaaatagtaaatggtagcgtcaaacccaatgattacgtggtaatcggaattgacagaggtctcaagcaattagccacgctatgtgtcttgaataaagacggagcaatacaaggtggttttgaaatctatacccggagctttaatgccgataaaaagcaatgggaacatcgttttatggataaccgggatatactcgacttaagtaatcttcgggtggaaacaacggtggatgggaagaaagtattagtggacttgtcgtcgataaaggttaaagatcaacggggaaattatacccaagacaaccaacaaaaagtaaagttaaagcagttggcttatatccgcaaattgcaatatcagatgcaggttaatccagaaaaagtaaaagcgttcgcagcgcaacatagaactcctcaggatattaaagatcatatgaaggagctcatcactccttacaaagagggaagccactttgctgatttacctttggatcgtattaaatatatgttggaagcattttgtgcttttcacacggaaaatgatcaaaccagtttacgggagttgattgaattggatgcagctgataatttaaagtcaggtatagttggaaacatagtaggggtaatcgcatttctccttaagcgattcagttacaacgcatatatatctatagaaaatctgacgagagcattttataatcagcgagacggattgtctgaaaaggaaattccgagagatcatgattttatggatcaggaaaatctggtccttgctggtttgggaacttatcactatctcgaagtgcaattattgcgaaagttgttcaggattcaatgtgatgcagggatcatcaatttggtgccagcttttcgtagcaatgataactacgaaactaccaggaagctttcgaaaaaacagggggtagaatacgtttgcaaaccgtttggtatcgtccattttgttgatccgatgtacacttccaaaaaatgtccggcctgcggaggcacaactgtacagcgaggcagttttaaggatgatattacttgccaaaatccattatgcggatacggtacttcccttgatataagcgaaaaaatccaaaagttgatttcagctaataaggctggtcaaaatattcatcttatcagtaatggagatgagaacggcgcctaccatatagctctgaagaccttaaagaatctttttggaaatatacaaaatgcgaataatgaaaggaggtatgtgaagagctttagaagcaagtaa

SEQ ID NO: 77 - DNA, 3141 bp, Unknown
  Metagenome-Derived Sequence
  misc_feature (1)..(3141): Unk8 Csm1 gene
atgacacatcaatatgaatttacaagaacaataaaatttaatcttaataataaaaaagacaatgacgccgctcaattaaaaaaatttttttcagatgaacatataaattttcaggaattatttaatgactttgaggggagttttagtgctcttttagatcaatttaaaaaggcggtttatcttaaaagcggcaataacttcggcaataacttaagggtaaaaaatagtttggaaattaaaaaatcatggttaaaacaatatgcgcgcgatgaattttataaaattgatgaaaaacaacgaaaatataataaatttccagcaaatttatttcaatctattttcaatggctggcttaaaagaaatgaatcattgttagagcaatttaaaaagattaatcagatgccgcaagagagccaaataaaaagatcagaaattttaacattattgcaggaaattaaaattactgataattttctttttattaaaaattttgtccaaccgggtatagcaaatgataaaaattctgatagtgatttagaaaatttaaaagaaaaagttgatcaatttgagattttaatgaataaagctatttttgctatggcgccggatttaagccagggggtagaggtgtgccgagcgagcttaagctattatacagtaaacaaagtttctaaacgagattttgacacagaattagaaggcaaaagaaaagaattaaaacagacgtataataaagagttgaatcaacagcttttgcaaacagttggatttttagattatttagaaaatgaatatcaaagtgatatccagcttgtctctattcaagatttatacaaagcgcttaaaaaatttaaagctcaaaaaaaatcagagtttatgcaagctgtgcaacagggaaagcaggcagaagaattaataaaagattttccactgtttaatgtgcagaaagatgtgatgcaaaattttattaatatttcaaataaaatagatgaaaaaaacctacaaaagcaaaaaagtcaaaatgaaaaagaaaaaaaaggattaactgaagaaattagaaaattaagaattaatcgaggaaagtattttcaaaatcggtgggggtttcctaattatgttaatttttgcaataacgtttttagaccagtggcaataaaaattggtaatttaaaagcacaaattagggctattgaacaagaaaaaatagaagctcgcttgctccaatattgggcgcatattcttaaaaaaggcaaccagtattatttattattgatacctaaagagaaaatgcaagaagtaaaagattttttaaataattcaagcccaagccaagaaggagaatatacactttatagttttaattcattgactttaagggcattaaaaaaacttattcgtaaaaatcttggcaaagaacaaacacatcttcaaaatgataataccgcgatagagttgtataaaaaagttttgcaaggtaaatatagcgaattacaaaatcttgattttagcggatttgaagaaaaaatcaaagaaatcgtccaaggaaattataacagtgaagaatattttcgtttaaagcttgaacgagtagcttattgttgttttgagcaaaaaattagccaagaaactatagctcacttacatcgcagttttagtgcgcttttattagaaatctccgcttatgattttgaaagaaatattagtagtaaaatgaaagaacattctaaagtttggcaagaattttggaccgtggaaaataaaaatgaacattttcctatacggattaatcctgaaattcgtattttttatcgtcccaaaagggagcaagaggatcttcaaaaagggaaaaaccgttttgcaaaggatcattttggcgtggcatttacaataacccagaatgctgctcaaaaaaatttagatttagcatttgctaaagaaaaagaaatatctgaagctgtcaaaaaatttaacgaagaaattattggcgaatttattaaagaaaaaggtaatgatttatattactatggtattgataggggacaacaagaattagcaactttatgtgtggtgaaattttctgaaaagcaaggaaaaacaaagcttgccaatggcgagatgcgaaaattcaatattcctgtgcctgttcccataaaattaaaattataccgtattaaagaagattgtctaaatagcgaaaaagaaattattattgaccgatacggcaataaaaaaaatgttaaaatgtttgaaaatccttcttattttatagacgagaaagaaaaatttgaagaaatagaatctacttgttttgatttaaccacggcaaagcttattaaagacaaaatagttttgaatggcgatgtacggacatatattgaacttaaaaaagctaatgggaagcggcaactttttgaaaaattgtcaaaaattgaagataaagcagaaattgaattttgcgaagacgaaaacggaaaaagatttcagataaagtcaaaaacaaccgaaataaataaatatcaatatatcattttttattcgcccgaagatgaaaaaataatgccacgtgatgaaatgaaaaaatatctacaaaattatcttaataatttgcgcaacggaaatttagccaaagaaaatattagtattgaaaagattaaccatttaagagatgcaattactgctaatatggtggggattattgcgtatttatttttatttaaaaaatatcagggaattattaatcttgaaaatttgattgaaacacattttagtcaaaataatgaaaatatagagcgccggttagagtggagtttatataaaaaatttcaaaaatttggattagtgcctccccaattacgtcaaacagtgtttttacgcaaagagaataaccaattaaatcagataggaattattcattttgtttcaaagaaaaatacgagtgcttgttgtcctcgttgtggcaatattgtgccaatgaggaaaagagaaacagataaatttaaataccatacttttatttgcgataaatgtggttttaacacccaaaatccaaaatcaccttttgattttattaaaaattcagacgaggtggcggcatataatattgctaaatccaacttaaataagttttattataatggatga

SEQ ID NO: 78 - DNA, 3345 bp, Unknown
  Metagenome-Derived Sequence
  misc_feature (1)..(3345): Unk9 Csm1 gene
atgctacaaaaaggtacatctaagatgctaattcaatttaaaaatcattattcctataacaaatcaataagattcaaattagagcataaaaatggcaagcttccgaaacttgagtctgataatgtagacttaaataaacttgttgacattggcaattctctaaaagatattttcgaagaactagtttatactaaaaataattataataaacttaatagtttagtctcgatcaaaaagcaatggctaaaaatatatttcaaaaatgagttttactctaatgggaaaatccaaaactattccctctcaaattttagttaccttccaaacaagctaattgagtggttaaataattggcaaaataatttaaaggcactcatagaattaacaaaacaacaagattttaataaaactaaaaaaagcgaaattgcgtatattctttcattatttaacggcaagtattctttttcatttgttaaggattttagcacttgtataaatcataaaaattcgcaggaacaaatactgaaacttcaaggagtagttgaaaattttgaaaaagtattaaatttatgcattcaagaatatttgccctctaaaagtgcaggtgttgtaatcgctcaaggtagcatgaactattatgctataaataaagagccaaaaaggtatgataacattcttgctgatttgaaccaaaagtttgaagagctagataaagaatatattgcaatgaaacagtataaatcttctcaaaagtcacgtttgtttgaatttattcgtaaaggattcagtaaagatcaaattttgagtgaatttaaaaaaaaagaaaataatgaagtaagttttgtgtacaataaccaaattataataaggatatatacacaagaattatttaaagacagttattgtttaggtgaagtaattaaattaaccaaaaagattgaagaattaaatgagtcaaaagatagtaataacaaccttcctgaagaaacaaaaaaagaaataacaaagctaaagaaagaaataggtttctattttataagaaggacaagaggaaaatcacataataactatttcaaatcttattatggtttttgcaacgataaatttaaaaagaaagctcaggaaagaggtagattattaacgaaaataaaagcaatcagaaaggaaaaaattgaaagccaaaatttaaggtattggtcactaatcctagatgatggaaaagataagttcttatggttagttcccaaagaaaatatgcaagaattcaggcgagaattgagcaaaattcacccttctggggaatcttctttgttcttatttcattctttaacgatgagggcattacataaactatgttttgcacaagaaagtgactttgtcaaggaaatgccaaaggttctaaaggaagagcaactaaactgcgaaaaagcaagtaatgatactgaaaccaataaaaggatcaaaagaaattttggtttaaattatataaaaactaaagatgaattaaccctctcttttttgaaaaaactaataatcagtgagtatgcacatgagcgtttggacttaaatcattttgatcttagtaagttgcaagttgctactaccttaaacgaattcgaagaatatcttgaagacgcttgttattatttagaaaaaatcagtatatctagttcgatgataaaagagttgcttgaagaatacaacattctaaactttaggataacttcctatgacctggaaaaaagaaataaaaacacctatcaaactcctgaaagcgatattaaaaggcatactaaagaaatctggaataaattttgggagggcgatagatttattagattgaatccagaaatcaaaataagatataggcaaaaaaatcaaaatattgaggattatctaaaagaaaaaggatttgatttgacaaaaataaaaaatagatttttacaagagcaatattcagttagcttcacttttgctcttaatgcgggcaaaaaataccctaaacttgcatttgtcaaaactgaagaaatacttgaaaaaattgaagaatttaatgatgagttcaataaacaatattttgataactcctataaatacgggattgatagggggaatattgaattagctactctatgcattacaaaatttaacaaaaatgacacatatgagtataaaggcaaaaaatatttaaaacctaattttccaacaagtcaagaagatataaaaacttatgaactaaagaacgagtggtataaaaggacagccatttctaatattgaaaccaaacctaaaaataaaaaaacgccgaaacggattattgctaatatttcttatttcattgataatgttgaaaatgaagaatggtttaataaaaaaacgtgtacttctatagatttaacaactgcgaaggtaataaaaggaaagttaattttaaacggcgatgttttaacatttttgaaactcaagaaggaggcagcaaaaagaattctctttgaattagttgcacaaaataaattaacggcaaaaaataaagaattaaaatggaaaagtgatgatggcaataattcagattcagtaaggttgatttgtgatgttttggataatgaaacaaatagtatttatttttatgaagatagtaaatacggaaggggttttgaagggttattaacaactgataaaacagcatattctaaagagggaattagaataaatctgcagaactacttaaatcatctgattagtgaaaaagaaaataaaagtaacaaagcatacagtcatgttccttccattgaaaaaataaatcatctccgagacgcacttgtagccaatatggttggcgttatttcttacttgcaagcatattatccgggaatagtcgttttagaagatttgaatcataaattattgataaaacactttgaagatttgaatataaacatttcaaatagatttgaacatgcgttaattgaaaagtttcaaactttgggtatggttccaccacatataaaagattatcttgagataagaagtagctttagaatgagtaggaacgattcttcccaatttggagcattaatctttgtcagtaaagagggaacaagtaaggaatgtccttactgtgaaaaaaaatggaattggggaaaggaaaaagagattgaactaaaattctcaaaaaagcaatacatatgtggtaaggaaaattcttgtggttttgacactaaacatattcagaatacttttgaattcttgtctgagattaatgaccctgataaaattgcggcttataacattgcaaagagaggatttaagagttttattaataagtctagcataaaaaaacaataa

SEQ ID NO: 79 - DNA, 3102 bp, Unknown
  Metagenome-Derived Sequence
  misc_feature (1)..(3102): Unk10 Csm1 gene
atggaaaattcaaatttatatcaagtcgttaaaacgattcggtttaaactagagccagttggaaagatggacacgcctaaatttggcgacaaaaacgcagagtcaaaggcaaatttgaccccgtttattgagcttgttaaaaagacgatgacaaacgtcaaagctttggtttttagcaagcaagacggcgaggacggtgaaaaatggcgtaaaattttggaggtaaattatagatttttacggagctatcttaaaaattcgttttacgaaaacagaggcgattcgcaagaaaaatcaaaaaaacataaaatttctgatttggagtatttgcaaaaggcgttagaaaatctttttgcggagtttgacgaaattttagacggattagaagattttgaaaaacgcaacacaaaaaaccaatacgaaaaacagcgccacgcacaagcgggacttttgctaaaccgcctttgtaagcgaagtaactttgggtttttaaaagcctttgtgggagcacttgcgcagactaacaagcctttttttgacgataaaacagataaactaaaaaagcagatagacaaatttgaaacagagctagaaaaacaaaaagaatttttcttgccataccaaagcaacggcgttctttttgctggcggttcgtttaaccgctacgccataaacaaaacgccaaaaatgcttgacaaggagctgagagaagagcagacaaatttaaaaaagagtctttgtgagcacaaaattaaaatcgatacactcaacactcttggtttaaaaaacgactgtccttgcacgagtttagacaactcttacacgtttatcaaagactacaaagctaagcaaaagtcaaaatttatcgagcttgtccaaaagggcgaatttgatgaggcaaaaaaggtaaatttgtttgagtgtagcgaaacggattttgaaacatttaaaactcgaacaaagcagattcaaaacgaaaaagacaaagacgagcgaacaaagctaaagcaaaagcgaggagaattttttaagtctcaaaagcgaggaaaattttttaagtctcaaacgcaaaactacgaaaatctttgcgacttatacaaaaaaatagcccaaaaacgagggcagatagtggctaaaatttgtgccattaaaaaagaaaaagagatgtgcgagcaggtgaagtattggtgcgtggcactagaaaaaggcggcgagttttatctttatatgtttttgcgagatgaaaacgataacatcaaaaacgcttacgactttgtctctaaacttcaaacgcaaaaaagtggtgaaacaaaacttcactactttgactctttaacgctaaaagcagttagaaagctttgttttaaagagacggatggcagttttaaaaaagcgctcaaaaatgtaaaatttccagagtgcgagcaaaatctagacgaaaaagtgaaaatttctttttaccaaaatgtcttaaaaaatgccaaaacgctaaatttgtctaaatttgaaaatttacagagcgtaacggagggcaaatttgagtcattgagtgaattcgaagtggcgctaaacatggtttgttacacaaagaccgtttgtgtttcagagagcgtagaaaaagagcttaaaaaattcaaaccgcttgtttttcacataacttcgcaagatttggcggcaaaaagagagaaaaaagcgcacacgcaaatttggcatgagttttggcgtgagagtaacgaaaaaagtaagtttccgttacggctgaatcctgaactgaaagttatgtggcgtgaggcgcgtccgagcagagtcgaaaaatacgccgaacaaagcgacaaatttgaccctaacaaaaagaatcgttacttgcatccgcagtttacacttgcgttaaactttacgcaaaacgctcacaacgaagcgataaatttggcttttaaagatgtacaaaacaaaggcgaagcggtgaaaaagtttaacgagaattttaaaagtagcgaatacgcttttggcatcgatgtgggcacgaaagatttggctttgctttgtttgatagacaaaaacaaaaaaccagtaaattttgacgtttatgaaatttgcaacgagaatgaaatttgcaacgagaagttaggttttgaaaaatttggtttttacaaagatggcacacggcgagacgagccatacaaactcataaagaatccatcgtattttttaaacgagtctttgtataaaaagacctttaacgctacgaaagaggagtttgaaaggagttttagcgagctttttaagcgcaaaagcgtttgtgcgctggacttgactacggcaaaagtcatctgcggaaagataattttaaacggcgactttagcacgcacctaaatttaaaaattttaaacgcaaagcggaaaatttcggctaagctgaaaaaagatccaacgcttaaaattgaatacgacaatgacgacaatattttgtttggtagcaatgtgattttttattataacaataagtatgaaatagttcgaccatacgatgagataaaaaacgaaattttcgaatttcacgaaaaacaaagacttgacgatgcaaggctagaagataacataaacaaaacgcgtgcgaatcttgtggcaaatatggtgggcgtgattagctttttgcataaagaattttctggttttgttgtgctggaaaatttaaaacagagcgagatagagggaaatcataggcttaaatttgaaggcgacattacgcgtccgcttgagctagcactttaccgcaaatttcaaagtaagtgtttaacgccgccgataagtgagcttattaaactaagagaaggtgaaaaaaatgaaaacgttgaaagtgatttgattttgcagtttggtattattaaatttgtagataaagacaaaacaagtcgtttgtgtccagcgtgtggcaaagatgcgtatgaaaataataattccaaatataagacagataaaaaagacggagtttttgaatgcgctggatgcggttttaacaacaaaaacaacgctggcgactttgccgcgctagacacaaacgacaagatagcgacgtttaacatcgcaaaaagaggcttgtaa

SEQ ID NO: 80 - DNA, 3705 bp, Unknown
  Metagenome-Derived Sequence
  misc_feature (1)..(3705): Unk11 Csm1 gene
atggaaaagaacgaaatagcaattagtgaatatcaaacacaaaaaaccattagatttggtttgaccgccacaaatcaaaatctgtattccgaagaaatcatgaaattattggatatttcagaaaaaagagtagaaaaacaagctgaacaagcaaaaaaagtaaataatgatgccgataaaaacaatcaattaagatgttgtttggatcaaataaaagagtatctgaaaacttggagtaatatttatccacaaattgattttttggcaattacaaaagatttttacaaggtaatttcaaaaaaagcaaggtttgattttgataaaggaaacggttctgaaataaaattatcctacttacaatcaacttattacaacaagaaacgctatctatatattatagagtcttggaaggaaaatttgcggaaaacagaaaatttatatcggaagtcagatgatttgctgaaagtatttgaagaagccaaaaatcaaaaccgtgacgataaaaaactgaataaagtggaattgcgaaaaacttttttaagtttgtttaatcttgtaaatgagagtctgaaaccattaatcgaaggtaatctgtttattgtaaatgacgacaaaattgacgaacaaaatccaaagcatgattgtgtatccgttttcatttcaaaaacagaagaaagaaggaaattatatgattatatctgtgatttgcaggattatttcaaagacaatggaggctatgtgccattgggtagagtcacattaaataaatggactgctttacaaaaatctaataatagagatgcggaaatcaatagaattattaaggaattaaagattaatagtgtttccatacaaaatattgagtatgaatacaataattttgctaataattttaaagaaaagaaagacgaaaatggtaaaattgtcaaaaacaatgcagggaatattatatgggatttaaaagcagatgcaaaatctgttatcgaaatctgtcagtttttcaagtataagcaagtgccaataaacgcccgcttaaatcttgcaaaaaggttggagaaaagtatcgactttttaagtgaatttggagtttctaaatcacccgcattggattacaaaaatgacaaaaacaactttaaccttacgaattatccgttaaaaattgcctttgattacgcttgggaaaattgcgcaaaagccaaacacgaagagattccttttccgaaagagcaatgtgaaaagtatttgaaagatgtttttgatatagatattgaatgtaaagaaaagtgccaaaacaaagaatgtaaaggttgcgaaaaatgcagaggatattatttaaacaaatatgcagatttaatacgattcaaaattttactcggaagattgaaagcggaatttcataaaacagacgaagaaaaaaataaaagcaacatacaagaattgagaaatatttttagagacttagattatcgtggtgacaaaagattaaataaaaatgaaattcaaaaagcagtcaatgcttggtttgacaacaaagaacaaagtattgggagaaagaaagaagacgaaatacatttaatggagaacgaaaaaaacaaattttccttatccatgcaaattatcggtcaggagagaggcggattaaaaagtagaatttcaaaatacaaagcattaactgaaatgtttaaagtttgtgcttcaaaatttggaaaacaatttgccgatttgcgagattatttcaatgaagcgtatgaggttgataaaattaaatatcgtgcctggattattgaagatgaaaaacaaaaccgtttcattttatttgtaaataaagaaaaagaggttgatctaacttcagaagaaggtgatttatatttttatgaagtaaaaagtttgacatccaaatctcttgtaaagtttataaaaaacagaggcgcttatccggattttcataaaatcaacaatcgtcaaatagacttaaattcaggcgaaaaagatagtcgtggtaattttattgacgatgtaaaaatacattggagtacctataaaaacaatcaaaagtttttagataagttaaaagattgtttgcaaaattcgacaatggctactgtccaaaagtggagtgagtttgagtttgagtttgatttttcaaattgtgatacttacgaaaagttagaaaaagaaattgatagaaaaggacataaacttgaacgaaaaacaatttcgctaactactattacaaacttggttgaaaacacagcatgtttattacttcctattgtaaatcaagatcttaataaaggaaacaaacaagcaaaaaatcaaaaccaatttacaaaagattggtttgatatttttgaaaataaaaagcgtttacatcctgaatttaacatattctatcgcttcaagacaaaagattatccgaatacaaaatttaaaaatggaacagaaaaaacaaaacgttattctcgtttccaaatgctggctcattttggctgtgaagttattcctcaaggcgattatttaagcaaaaaagaacagattgccatttttaacgatgataaaaaacaaacagaagaggtgaaaaaatataacaaaaatatttcttcggatgttgattatgtgataggaattgataggggaataaagcaactggcaacactttgcgttttagataaaaatggagtaattcaaggcggtttccaactttttacacggacttttaactcagaaacaaaacaatgggaacaccaagaattagaaaaacgcaatatcttagatttatccaatttgcgggttgaaacaacaattacaggtgaaaaagtgttggttgatttagcaagtattcaaaccaaaaacggcgaaaaccggcagaaaatcaaactaaaagagttggcttatattcgtgatttacaatatactatgcaaacaagagcaagcgatttgttggattttgcaagcaaaataaattctgctgacgatataacagaaaataatattaaaaactttatttcgccatacaaagaaggggaaaagtatgccgatttaccccaaaaagagatgtttgatttgcttacagaatggaaaaatgcagaggaggaaggaaagcgaaaaattgccgaacttgaccctgctgacaatttgaagtcagggattgttgccaatatggttggagttgttgcattgctttgtgcaaaatataaatacagagttcgcattgctttggaagacctaacaagagcgtatggcatccaaaaagatgcattaagcggagcaacaatttttcaaaatgacgaagattttaaggagcaagaaaatcgcaggcttgccggcgtaggaacaatgcaattttttgaagtacaacttttaaaaaaaatatttaaagtacaaattgacaaagacttacatcttattcccgcatttcgcagcatagccaattacgaaaaaattgttcgtagagacaaacagaatagcggcgatgaatttgtcaattatccttttggaattgtgtgttttgttgtcccaaaatatacttcaaaaaggtgtccgaaatgtgagaaaacaaatgtcaatagaaaggaaaatattgttatttgtaaagaatgcggctttcaaaccaaagaaggaaatccttacgaaaaaaataatattcattttattacagacggagaccaaaatggagcgtatcacattgcaaaaaaagcattgtaa

SEQ ID NO: 81 - DNA, 3171 bp, Unknown
  Metagenome-Derived Sequence
  misc_feature (1)..(3171): Unk79 native coding sequence
atgaaagattatcaaaatttttatgaattaagaaagacgattcggtttattcttgaacccaaggaaattaagaggccttatcagccgatagtcaataatgatgatttgggaaagcgaatagataattttataaataaatatggccatgccatacaaatttttagggaattaatttatgccgcgcccagagattctgaagagaaaaaattaagtaaaaatatctccgttaagcattcttggctgaggaattacaccaaaaatgacttttttaatgtgaaggaaaaaattattcaatatgataaagacaataaaaaacgaggtaacaaaattgctattgataataccaatataaaatttttaaatgattattttgaaaattggcttgaagaaaataaagaatgtatcgctaatttaaaaatatgtttaaatcagccggaagaaaaccaaaaaaaaatttccgagtttgcgtattggattagaaaaataaccaagcgaagtaattttgaattcatttttgagttattcaacggaagtattgaccataaaaatagcaatgaaaaaattgatgctgcaaaaaaagaattggacgaatgtaagccattgcttgcattattggaaaaagcggtcttgccaagccagtcgttgggagttgaaattgaatgtgcaagtttaaactattatatcgttaataaaaaaccgaaagattatccacaagaaatacaaaataaaaagaatgaattgcagcagggtcattctttttctagaaatgagcaaaatgtattaaaccaggtcggttttatagacataaaattacctattactgatttgaaggaagcgatgaaaaaatttaaggcggaacagaaaaaaatattttatgaatttgttaataagggagagatgtatcaagaattaaaaaataaggtggatttaaaattattgaatgatattagcgaaaataattttaataaatttgaaaaagaaacagatgatcagaaaagaggcaaacattttcaattttcttttcaaaaatataaaaatttttgcaatatttataaaaatgttgccgtaaagttcggcagaataaaagcgaatattaaatctttagaaagagaaaaagttgatgctgagaaattacaatcttgggcggtgattttggaaaaagacaaccaaaaatatattttaaccatttcaagagacgcgaaaaataatcttcaaaatgccaaaaaatatattgacgatttgcaaaacgagaatggcgggcaatggaatttgtacgctctcgaatcgcttactttgcgtgcattggacaagctttgctttggatcggataaaaatacttttatgccggcaattaaaaatgaacttctgcaaaatgataattctttttttataaatggtgatttaaaaagaaaagatcaattttcagaagacgggaaagagctgataaagttttaccagacggtattaagtttaggctcaaccaaggaaatgctggcgattgataattttaaaaattttgatgagcttgcgattaaagaatatggagaattggctgactttgagagattatttaaaaaaatttgttattacaaaaaatcaatagctatttctgaagatacaaaaaagaaaattgttgatgattatcaaggaaatttgtataaaataaccagctatgatttggaaaaagatgacgcagaaattttggcgtctttacaaaataaaaatcatcttggcagaagccaccccgaatttcatacaaaaatctggcttgatttttggacagacggaaatgaggaaaagaattacgaagttcgtttgaatccagaatttaaaataaattttgttgaaaaacatcccgacgaattaaaagatagggatttgggcaaattgaaaaaaaataggcggttaaacgaacaatttatgctttcaactactataactttgaatgctcacggaaaaaataccaatttatcatacaaaacgaccgatgatattaaaaaatatattgagaaatataatgacgagtttaacaaaaaaataaaaccatttgatatttattattatggattagacaggggaaaggatgagcttttaactctcggcttatttaaattttcagaaaatgaaaagataaaatttattaaacaagatggaacgccgggagaatataacaagccggaatttattgatctggaaatatatcagcttaagaaagaaaaatatttagcaaaagatagcagaaacagggtcgcttataaaagcattgatctatttctggacaacatcggaatcattgaaaggatttcagtagaatcgtgtattgatttatcttgcgctaaaatagtgaaaggaaaaataattttaaatggagatatagctacttatttggagttaaaacgagtaagtgctttgagaaaaatcttggaaggtgcagctaaaaataaattcagatcagataaaatttgttataatgcggataaaggaagtttatttttaaatattgaaaaccgcgggaaattagaaaatgatgatttatatttttgtgatgatcggtttgataatattttatctttggacgccattcaaaaagaattgcaggattattacgacggaattaaaaacaatagcggtaatgctgaaatgatcccgatagaaaaaatcaaccatctaaaaaatgccttgtgcgctaacgctgtcggggttataaattatttgcagcaaaaatattttggcatagtggcttttgaaaatttagatatggctaacaagaatcaacgaattagtgaattttcgggttatttgggcagtatgattgaattaaaattattgcaaaaatttcaaacgctttcccttgtcccgcccggtttgaagcaagttatgagcttgcaaaattttaaggagataaatcagattggagcggtattttatattgaaacatgcggaacaagcaataaatgtccgcgttgtggaacagaaaattccgataaatcgcagaaatggaatgcccatgcttataaatgtaaaaataataattgcaattttggcactacagaggacaaaactaggaatgatttaattgcgttggataactctgacaaggtcgcttcatataatattgctaaaaaaagcttagcagaattgcattccaagtgttctttgaaaaatgagtaa

SEQ ID NO: 82 - DNA, 2721 bp, Unknown
  Metagenome-Derived Sequence
  misc_feature (1)..(2721): Unk14 Csm1 gene; TGA codes for Gly
atggagaaaaattataagagtgaaatcaatttatcttatgaagacattctaaataaatttaatttattatgaagagctattgatatcgcaaatgattttaaaaattccaataatcaaaataacttttctcttgatgaatatcctataaagttagcctttgattatgcttgggaaaatacagcaagaagcttgaaaagaactatacctttccccaaagaggtatgtaaacaatttttaaaagataattttgatgttgatatcgataatgcagattttaaattatatgccaatcttttattcatagcggataacctagcaactatagaatataataacccaaataatgaagtagaacttataaatgaaataaaacaagcatttgaatgcattagctttccttttgataaagaagtatataaatgacataaagaagctattttggaattattagataaagaaaaatctcaaagagactattccactatattaaaagcaaaacaagaattgtgattattgagatgatgattgaaaaataagattaaaaaatacagagatttaacacagagattaatagacaaaaagaattcacatttttgaatcgcgagttttgtgggaaaaacacttgctacaataagagatggtttaaaggaagaaaatgaactaaataaaattagtgattactgagtaattattgaggatagtaatcaagataaatatctacttactctagagctaaatgggaaagatataagagatagaattagaaatagcctatgaaactgagaatataagacatatgaagtaaattcctttacttcaaaagcattaaataaatttatcaaaaatcctttatcagaagacgcaaaaaaatttcatgggaaatataaggatgaatatagtttttgatatgaaaataaagattgagatttcacttataaaataacaaaagtttcaaaatatgatgaacaaggaaaatggacatgataccaggaaagttttttaagtcatataaaaaagtgtttaattgactctgagatttcaagagaacaaaattgggaagcctttggttggaattttgctggttgtaatacttatgaagagatagaaaaagaagttgattctaaatgatatcagttgactgaaaaccttatttcaatggggaatttaaaaagcttggtaaaagatgaaggttgcttgttatttcctattattaatcaagatatttcaagtcaaaaacaagaaaataaaaacatttttactttagaccttgaaaaggtatttgagtgaaaagaatgtaggattcatccagaattttctatcttttatagaaggccaatagaagaacacaagaaggagaataaatcatgaatcataaatcgttttggaaggttacaattattggcaaatcttggtatagaatttgttccaagaaatccttcttttaaaacaaagaaagaacaaaatagaattgcgattgatcaaaagaagcaaaatcagttagtgcaagagtttaaccaaaaaaaagtaaatacatattttgaaggattagataattattatatttttgggatagatagatgaatcaaacaactagcaactttgtgtgttactgataaagattgagttatacaagattttgatatttatacaaagcactttaatagtgaaagtaaaaaatgggaatacaaatttcatagaaaagattgaatattagatttaactaaccttaagattgagtctgatagaagttgaaataaatacatagtagatatatctttatttcaagctaaagatgaagattgaaatcctacaggtacaaataaacaaaatatccaacttaagcaacttgcatatatcagaaaattacaatatcaaatgtctgcaaatgaagaatgagttttaaattttttgggaaaatataagaacaaagaagaaagagaacaaaatatggaagaactaattactccatataaagaatgaaaaaattttgcagatttaccaatggatatttttcaagaaatgtttgaaaattattatagattaaaaactgatcaaaatttgtctgaatctgagaagaaaaatcttatgaagatcactacagagcttgatgcaagtgaaagcttgaaaaaatgagtagtcgcaaatatgataggagtgatttattatttgatgaaaaaatatgaatataaagtgaagatttctcttgaaaatctttcaaatgcttggcttttttcaaaagacggactttcttgagatgttgtgctaaatacgaaaaatgatgaaacaatggatttaaagaaacaagataatctagcgcttgcttgagtttgaacatatcatttctttgagatgcaattattgaataagttatttaaaatttctaccgaagaatgagttttgcatttagtcccaagtttttgaagtgtaaaaaattatatagagattatgaagataaaaggaaaatatgtatacaaacaatttggcattgtttatttcgttgatccaagaaatacaagtaaaaaatgtcctgtttgttgaaagtgatgaaaaaaatatatctcaagagttgacaatgttgtaacatgtaagaattgttgatttgatacatcatcagacaattccatccttataaataattataaaaaacaatgaaaaaatattcattttataaaaaatggagatgataatgcagcttacaatatctgagagaaaatacgttaa

SEQ ID NO: 83 - DNA, 3516 bp, Unknown
  Metagenome-Derived Sequence
  misc_feature (1)..(3516): Unk15 Csm1 gene
atggaaaatgcaacaataaaaaatccaaaatacagttatatgaaaagtataaggttcaacctaatagatactgacaacaaattatctgatttaaaatcaaatagtaatcaagatagtataattaatttggacaatattttcagttcatatgataaattaatcaaagagttcaaatcacttttttttgaagttgacaaaaataaagattacaaaagaaataactctgaaaattatattcttaaaagaacaatcaaaattaagaagcaatggttcaaaacatattttaaggaaggatggaacttcaaggaagaaaaaaaacaagagatcgaaaaaacccaaacaaaaataaatgaaactgtctctaaatttgagaatctatgcaaacaactgagaactgatattgatcatgataaaaacagggcacataaaaagcatagaaattctaatttctcatcgattcttcaacaaatcaaaaacaaggatgtattctatttattaaacgatttagttaaacagtcgataaataaaaatgaagtctctaaagttaattcattaataaaagacttcagttcctttgaaaaaaaattaaatcaactatcaaaagaatatttagcttctcagagcttaggaatcgaactatatcgaagttcttttaattattacaccttgaataagtcttcaaaacattatctaaaacaaattgaaaaaaagattcaaaactataaagatgagaaaaataaaacacatattgaatttcaaaacaattcaattaaagtaaatgatatgaaattgcaacttacttcaaaagatttagaagtaatggaaaatataaaaagtgaactaaaaatcaagtttccactaaatcttgaagaaagtaaatatttcatgaaattattcaaagcaaaattaaaatccgatttgttcaaagattgtcaaaaaaataatgaaattaaggattattcttgtttatttaatgagaataaaaaattaaaaaaaatatttgatttgacaagagaaatacaaaatgaaaatgaatttaaagaaatacaaaatttaaagaaagacagaggggaaattttaaagtcattcgaaaattggaaaaactttatcaattcatacagaaaaatttctcaagattacggaagaataaaaacaaatattgctaactatgaaaaagagaaaattgattcacaaaaattgaggtattggaacttattcttaaaaaaagataatcaaatatatattctgttcgttccaattgaattcagacaagatgtcaaagagaagatcacaaatgcaaataccgttaactcaccaaataaaatatttatgattaaatctctaacaaaaagagcgttacataaactttgttttaatgagtatggtagttttttaaacgaaatgaaaaagaaaaagaaagaaacatataatgaaatcataaaatttaaacaaaaattcagagaagaatttgagcaaaataaaattgaaaaattaaatcaagaactaatacaagagctaaaaaagaaaaaaataaagtttgaaaatgatgagttaaagagatctaaaaattttgttggttttatgaagaattttgaaaataaaaaatatggtcaattcaaaaaacagtttaaagaaaaaattgaaaaattaaatcaaaaatatactaaacaaaaagaggaaaaaactactaaaatattaaaagaagtcttgcagtctgattatgcaaaatcaaggctcgatttaaaagattttgatcttcaaaaagtgtatctagctcagacgtcaaatgaatttgaagaagaattagaaaaagaatgctataaaattttaccatattatattgataataagttattgtccgaattagaaactctatttaaagtgtttaaatgtaaaatccaatcttatgatcttgataaaagatttaaaaatgaaacacaaacaccaaaaagtctagaaaaaagacatacaagagaatactggaacgaattctggcaaaaattaaatcaatcaaaaataagattaaatccagagatacgagtcaactataaagaaaaagacaatgagatggaacgatacctctggaaaagatataatgtcgataaagaaaagatcaaagaaaacaaatatggttttaatcggaatctgcaagataaatatatcatcaacttttctttcttagtaaacacaggtaaaaaatttttagatcttggatttgcagattcaaatgagatcaaacacgaaattgaagatttcaatattgatttaaataaaaagatgaagaatccttttttttgtgggatagatattggagaagtagaattagcaagctctgctatctacgcctttgatgataaacacaaatatcaattcaataatcaaaagttcataagaccagttattcccgataatttgccgataaaatgtttaagactaaaaaaggaatattatacaaaaagtagaaaaccaagtaaacaaaaagtaaattttaaaaaaatcgaagaaagacagataatatcaaacctttcctattttagtgatcaagaagagttatttgatgaaatttctccctttgccttaaacttaacatgttctaaagtaataaatggcgtcattatcgaaaatgcagacatacttacttatttacaatacatgaaaaaattagctaaaagaaggttatttgaaatttattcaaaaggatttcttgaaacagataacaaaaagcataattttcaagatttgaaattagattggcaataccctaaagaatcaaacaaatacaaatcaaataatttaatcttatgcgataaagaaaataaaattgtaaaggcaaaaatatttactttcatctacgaatatgaaggaattaaaaccaaaaatggagaatatgaatttgattcaatgaaggattattttaacaaatatttaaataaattaaagaagataaaaaaaagtaatgataataaaataataaaagaagatattcctagaataaacaacttaagagatgcattagtttcaaacatgattggagtattaaacttatttaataaatttgttgacctatatgtcgttttagaaaacattccaaataagaataagcaagatgaatatctcataaaaaggttagagtctgctttattccaaaagtttcaaacttttggaatggttcctccaaatgtgaaaaatttaataaagattaaaaaaatgctacagactaaagaagataaagattccggaaaagaaatccagattggcaatatcttatttatcaacgaaagaaaaacaagtcaaacatgtccttattgtgaaaacagtgataacaatcaagatcatgaaaaagggatttttttatgttcaaaatgtaatttttcaactaatgataaagaaaaaatacatttaactgaattaaagattttgaaaagctgtgatatagttgcagcatataacattgcgaaaaaaggttatcaatttatcataaatggaacaaaacataaaaatatcaaatctgaatga

SEQ ID NO: 84 - DNA, 3036 bp, Unknown
  Metagenome-Derived Sequence
  misc_feature (1)..(3036): Unk16 Csm1 gene
atggattaccaacaatacgaatttacaagaacaatcagatttaatctctctggtgatgataaacgcgccttaatgttggatttgctcgacgatacccaagaggggatgcttgccgcttttcaggaaacctacaaaaatcttttattcgcattccaagaggcgatattgcgggcagatgggagtggtaatttaagagtagggcggttagaaataaaaaaatcatggcttagacagtacgcacgagaatatttttatgcgcttagcgaagacgaaaggcgatgtaagaataagtttcaggcaaagttgtttgatcgtgttttgagcgactggctggaaagaaacaatgaattactacaaagacttaataatatattgtctttgccgcaagaaagcaagacgggggcatccgatctttctttattagtgcgacagctcaaaggtgctgaatatttttatttcatacgtgattttacgcaatcggggataataaatgacaaggattcagacgagcatattaaaaatttggcgggtatagttgaaaaatttgaaactctgcttgacaaggtgctttttcttacggcgccaaattcaagccaaggagttgagacaacgcgcgctagctttaattactatactgtcaacaaaatctctaaaaattttgatgagaacatcaagaaagcgaatgggcgactgtgcagttcttatcaaaattcaatgaatgaagagctgttacgaaaagttggatttttgaagtatctcaaagatgaataccgagcagagctacaaaatgtttcgttaaaagatctgtatgaggcgcttaaaaagttcaaatcgcagcaaaagacagcttttatacaagcggtgcaaaaaaataaatcggagaaggaattgatgagggaatttccattatttaatggaaaacaacccgatacgcttcagaaatttattttagaaacagacaaaataaagcgcggggcatactttcaaaaatggggttttgataattatatttcattttgtaataagatcttcaagccagtagctatggaaaccggaacgagaaaagcgaaaatcagggcgcttgagcaagaaaagatagaggcacgtcttttgcagtattgggcgcacattcttgtaaaagacggcaaatattttttgcttctaattccaaaagaaaaaatgggagaggcaaaagtatttttcgctcgactttctgatcaagaaggtggagaatacaccctctacgcctttaactcccttactctgcgcgctctcaaaaagcttatccgcagaaaccttggaaaagagcaagttcgccttagcgccggagatgccgatgcaatcgcgctatgccaagaagttttgcggggtaggtatcatcagctcaaagatttggacctcagcggttttgaaaaggaaatagcagaaattgccaatactcaatacgaaaatgaggaagaatttagaatcgccctagagcaggtggcctattacctttcggaaaggaaaatgaacgaagaaagcattgaatatctcaaaaaaaatcttggcgcgatattgcttgaaatctcttcttatgaccttgaacgcaatatcaccggcgagtcaaaagagcatacacggctatggagcgatttttggaatccaaacaacaaaaaagagtgcttttcgacgcgtttaaatcctgaattgcgtatattttatcgtccaccaagagaacaaaaagaccctaaaaaacaaaaaaatcgtttttcaaaagatcatcttgccgttgcttttactattgcgcaaaatgctgcgcgaaagcgcatggaaacaagttttgccgaagaaaaagatttggtagagcaggtcaaaaaatttaacgaagaagttgtcggtaaatttatagatgaaaaatcggacaatttatattactacgggattgatcgtggacaacaggaattggcaactttatgtgttgttcgcttttccaaagagcattatgaagctatgcttgaggataactttataaaaaagtttagcaaaccgatccctgcacagattacagcctatcgcattaaagatgaacatatgtcctatcggaaaaatataacaagagacctaaaggggaatgagacggaggaaatactattcaaaaacccttcgcactttattgatgaagtagaaaactttgaggaggtttccacaccctgcatagacttaactaccgccaaactcattaaaggcaaaattatattaaatggagacatacaaacatatctggcgctcaaaaaagcaaacggcaagcggcaactatttgagaagtttgcaaaaattgatgattccgcaaagattgaatttgatgatagtgaggggcgatttcaggtgaagtcaaaagcgacagagcgtgaggagtatcaatttcttccttactatggaccggaacaagaaaacatatctccgcgggaggatatgcggcgggaactacaggcctatcttgataaattacgctcaagcgaaagttttgaagaagatataagcattgagaaaattaaccacctgcgtgacgccatcacttccaatatggtgggaattattgcgtttctatttacggaatatccgggaattatcaatttggaaaatctgcacagcagagagaacattgaaaagaattggcgtaaaaataacgaggatatctcgcgtcggctggagtggggcttgtataaaaagttccagaaaataggacttgtgcctccgcgattgcgtcagacggtcttgcttcgggagaacgagacggaaagacaagaaaaactcaaccagtttgggattattcattttattcctaccgagaaaacgagtgcgcgttgtccttattgtggcgaaaatacgccaatgaagcaaagaaatgaagacaagtttaaattgcatgcttatatttgcaggagtaatgaggaaaactgcggcttcgacaccagagaaccaaaatcaccgcttgaatttattaaaaattcggatgatgtggcggcttacaacattgcaaaaaaacggctttaa

SEQ ID NO: 85 - DNA, 3090 bp, Unknown
  Metagenome-Derived Sequence
  misc_feature (1)..(3090): Unk17 Csm1 gene
atgcgtaagatgtttttgtctcttgcgaatattgtctgcgaagtcttggtacctttatgcaacggctcaatttgctttcctgatattgaaaagatgtcagataaagatgagaacaagtatcttcgcgagtttgcggttgattataaaacaaaaatcgatttatttgattctatctcagaattgcgaaaatattttgaagaaaacggcgggaatgttcctttttgccgggcaacgcttaatcctaaaacaaaaataaaaaatccaagttcaacggataatagcattgaagctgaaattgagaagattgggatggaaaaatatttgcaaacaacagatgaaataattactgctattaataaaataaaacaaatgcaggattccaaactgccgcttattaagcgggcacttctatttaaatataaaactattccggcggttgttcagtttgatttggcaaaaagtatcggcaaaaaattaaacaaagaagaacaagaattaagaactattattcgtactatcggacaaactgcaagccctgcaaaagattatgcagatttgcaacataaaaaagagttcaatatcaatcaatatccgttaaagcctgcttttgattatgcctgggaatcactcgcaaaagcggaatatcataatgatattgaatttccaaatcaaatttgtaaacaatttctaaaagatatttttaatgttgatactgaaacagatagttatttcaaactttatgcgcaatttttatatttgcgggagcttctagcaacattagaacatagccaacctacaaatcctgagaaaattgtgaagattatagaggagttattggaaaaaataaatgcgtggaaagaaattgatgataaaaatagcgaaaagtacaaaactgccattagcaattggttaaaaacattcaataaagaagataataattttaaaaatgcaaaacaaaaaatcggtttatttcgcggcggattaaagaagaaagccggagacaaaagcagatgggaatatttgagaaaacctgatgaaaaagaagctccaaaattaactgcatataacgcattaacgcaaatatataaagatattgcaacgaacttaggcagaaatcttgcagatatgcgagataaaattactaacgagtcagaacttaataaaatttctcattatgcagcaattatagaggataagaacggcgataaatatgttcttttgaaaaaatcagacaaagatgaagaattcgctttgccatgtgaaaaagacgcagaatataagacatacatcgttaattcaataacttcttctgcgattgctaaaatgattcgtaaaaagagagctgctgatctagctaaaaatattaggctaaaaagcgaagaactgaatgatgaacaaaaagaggctaaaaacttaaaagactggattgaattgataaaaaaacagcagtatgatttcgaatttaatttaaatttgaataataaaaattttgagcaaataaaaaaagaaattgatgcaaaatgttatcaattacaaaagggtaatatttcaaaacaaactcttgaaaaattgattaatgagcaaaaagaatggctgcttcttcctatcatcaatcaagatttagcaaaaagagataaatcgactacaaatcaattttctaaagattggcaaaaaattttttccgataaaaggtgtggatacagattaacaccagagtttagaatctcttatcgcaagccaacacctaattaccctcaatctcagataggggataaacgatattcccgttttcagatgatagcacattttctttgcgattatattccgcaaggtaatctagaatataaatcaacgcgccaacaaatagaaatttttaaagattatgagaagcaggaagaatcagtaagaaattttacttataagatatatgctaataatgattatttaatatttggcattgaccgcggactaaagcaactggctacactttgtgtcttaaacaaagaagggaaaatatatggtggttttgatatttacacacgtagctttaataaagataagaaacaatgggagcattctttaagtgaaaagcgtaatattttagatttatctgatcttcgcgtagaaaaaacgattacaggagaaaaagtattggttgatttaaacagtataaaagtgaaaggtaatcaagataaccagcagaaaataaagcttaaagaattagcatatataagaaaattgcagtttaaaatgcaaacggaacatggaacagtaataaactttattaataaatatagaacacctgaagaaatccagaaaaatattcatgagttgataactccttacaaagagggtgaacattacgccgatttgcctactgaaaaaatttgtaatatgctgcaaaaattcaaagagttttcagataaaaatgatggaaaatcaaagagagagcttatagagcttgattctgccggcgaactcaaaaatggtatagttgctaatatggtaggtgtagtagcatatttgttagaaaagtataaatataatgtttatatttctttggaagatttaacaagagcatataggcgtcaaactgatggtttggacggcagggaattgtttagttcaaatgatgataaatctgtagattttaaagatcaggaaaatactgctttggcaggccttggcacttatcatttttttgaaatacaattactgagaaaactatttcgcatacagcaagaagatggaaatattctgcatttagttccggcattccgtagtgtggacgattatgagaagattattcgaagagacaaaaaaatagatggcaacgaatatgtggattatccgtttggaattgtgcgttttgttgaccctaaaaatacttctaaaagatgtccgctttgtagcagtataaatataaatagacacaaaaatattataaagtgccaacaaaaagcttgtggctttaaaactccatgggataaaacgaacgataaaaatattcaatatattcaaaatggcgatgaaaatggagcgtatcacatagcaaaaaagacattggataatttaaataataaaaaataa

SEQ ID NO: 86 - DNA, 3243 bp, Unknown
  Metagenome-Derived Sequence
  misc_feature (1)..(3243): Unk18 Csm1 gene
atggatagatttaagaatttatacgaagtaaaaaagacagtgaggtttgagttaaaaccgagtaggaagaaaatttttgagggcggcgatgttatcaaattactgaaagattttaaaaaagtacaaagactctttttagaaatttttgtttacaaaaaaaaagactcaaaattagagtttaagaagaaaagagaaatcaaatatacatggctcagaactcatacaaaaaatgaattttataattggagtagaagaagtgatatagaaaaaaattacgttttaagcaaaatagattttttgccagaagaaattttgcgatggcttgacgaatggcaaaaactaacagaaagcttggaagatataacacaaacagaagaacacaagcaaaaaagaaaaagcaacatcgcttttgctttacgaaaattttcaaagaggcaaaacttgccttttataaaagatttttttaatgctgttattgatattcaaggaaaacaaggaaatgaaagtgacgttagaattaaagaatttagagggaggctaaaagagatagaaaaaaattttaatgcttgctccaaaaaatatcttccgactcagagcaatggagtacttttgcataaagcaagcttcaattattataccctgaacaaaactccaaaagagtatgaagatttaaaaaaagaaaaagaattagaattgaatggggttttgtcgtgggcaatttataaaagagaacgagttattgatagacgaacagaacaaacagaaatcttatttgattgcgatattgactggttaaaaaagattggacttggcgatgaaattcagaactgggttcttgacgaagcttatcaaaaaatgaaaatttggaaggcaaatcaaaaatcagattttatagaggcagttgcgagagataaacttacattccaaaactttagaaagaagttcccactatttgatgcctctgacgaaaattttgagatttgctataaacttacaaaagagcttgataaaaaaccaaaagatgcaaaaaaagtagcacaagaacgaggaaagttttttaacgccccaaaagaaaaaattcaaaccaaaaactattttgaactctgtgaactctataaacgaattgccctaaaaaggggcaaaataattgcagaaataaaaggaatagaaaatgaagaggttcagtcccaactcttaacccactatgctatggtagcagaagaagaaaacaaaaaatttattgtatttattccgaggaaaaatggtgaagaattagaaaatcacaaaaatgctcataagtttttacaaggaaaagaaaaaaaagaatctggcgatgtaaaggtgtatcattttaaatctcttactttgagagctttggaaaagctttgctttaaaaaaactaaaaatacatttgctccggaaattgagaaagaaacaaaccctaaaatctggtttcccaaatataaacaacaatggaacaaaacaccagagaaacttatcgaattctataaaaaagttctgcaatccgattactctaaaaaatatttagatttggtagattttggaaatttaaataccttcttgaagactgattttacaaccttagaagaatttgagtcagtccttgaaaaaacatgctatacaaaagtgccagtttacttttctaaaaaagaatttgaaacatttaaagatgaatttgaagcagaagtttttgaaataaccactcgtagcgtatcgactgggagcgcgagaaaagaaaatgctcacgcaaaaatttggaaggatttttggagcaggaaaaatgaaacagcaggccatactattcgtctcaatccagaggtgagtattttttacagagatgaaatcaaagaaatgagcaatgcctcaaggcagaataggacatcagatgtaaacaataggttttctgaccctcgttttacacttgcaacgacaataacgactcatgctgataagaaaaagccaaatctagccttcaaaaaaattgaagacataaaaaatcatattgatagctttaatacagtcttcaatagagacttttccggtgtatgggtttacggaattgatagagggctcaaagagctcgcgactctaaatgttgtaaaattttctgatgtaaaaaataaatttggagtattacaaccaaaagaattcgcaaaaatttctatttataaattaagcgatgaaaaagcaattttaaaagatgtcggtggaaagagcttgaaaaatgcaaaaggagaagatcgaaaagtaattgataatatttcagaagtgctggaggagggaaaggagcccgatccaatactttttgaaaatcgaatagtctcttctatagacctcactcaagcaaagctaataaagggacatattattactaatggtgatcaaaaaacataccttaaactgaaagaaacatcggcaaaaagaagaatctttgagctgttttcaaatgctcaaatagataaaaatactacgatctctggaaataaaacaatcatgctgggtaaaaataatacaatatattggctttgtgaatggcaaaggcaaaatccttggcgagataaaaaagaatctttgatgcagtctctcaaagactatttacaaaatttagatataaaaaatcactttaaagatattgaaacaatagagcagataaatcacttgcgagattcaattaccgcaaatatggtagggcttctatttcacctgcaaaataagttaaaaatacatggagttatagcattagagaatttggatactgtgcagaaaaagagcgatagtaaaatgatcgatgagcattttgaacaaagtaatgaagatatctctcgtcgtttggagtgggctttgtatcgtaagtttgcaaatacgggagaagtgccaccacagataaaagagtccatcttcttgcgaggtgaatttaaggtgtgtcaaatgggaattttgaagtttgttgaagttggtggaacaagtcgaggatgtccaaattgtcaatctgagtggaatcaggaatgtggaaatcagtgcaatcccaaatgtaataaatgtacagaaaatgattcctataagaaaaataaaagaaaaaatgtttatatatgtaaagatgataatcaatgtaaattttcaacagaagagagtcgaaacttacttgaacaaaaccttcataactccgatgacgtcgctgcttataacatcgccaaaagaggcttggaaataaatagtatctag

SEQ ID NO: 87 - DNA, 3258 bp, Unknown
  Metagenome-Derived Sequence
  misc_feature (1)..(3258): Unk19 Csm1 gene
atggaaaaatacaaaattactaaaaccattcgtttcaaattgctgcctgataaaattcaagacataagccgtcaagttgctgttctgcaaaattctacaaacgcagagaagaaaaacaatcttttgagattaatccaaagggggcaggaattaccgaaactattgaatgaatacatccgatacagtgataatcataagctgaaatcaaatgtcactgttcattttagatggttgcgtttgtttacaaaagatttgttttacaattggaagaaagacaatacggaaaagaaaatcaaaatcagcgatgttgattatttgtctcgtgtgtttgaagatttttttaatgaatgggaaacagtaattgaaagaataaatactgattgcaacaggccggaggagtctaagacaagagacgcggaaatcgctttctcaataaaaaaaattgcaaccaagcagatgtttccattcataaaaagttttgtttataatagtaattacaaaaacagcgaagaaacaaaaagcaaactaaccgctttgctaaatgaatttgaaacagtattgaaaatatgcgagcagaactatctgccatctcaatccgcgggcattgtgattgccaaagcgagtttcaactactataccatcaataaaaaacagaaagattacaaaggatacactgatgatattgaaaaaatagagaaaggaatgaattcaaaatttcattatgaaagaaaatatgaccagttgcttgaagaattaaaccttatcgctttaaaagaattaccattaatcgaattttattcgaaaatcaaaagctataaatcaaccagaaaaatcgagttttcagaagctgtttccaaagggttggcgtttgccgatttaaaaagcaagtttcctctgtttcaaactgaatcaaataaatatgctgagtttttagaactgaccggcaggataacgcaaataagtaccgcaaaaagtttgctttcaaaagataatcccgaagctcaaaaacttcgagacgaaattaagaaattaagaataaacaggggtgaatattttaaaaacaattttcataaatatattagcctttgcaatttatataaaaaaatagctgacaaaaaaggcagattaaaaggccaagtcaaggggatagagaacgaaaggattgattcgcaaagaatacagcactgggcgttggtgctggaggacaatttaaaacattctctgattctaataccgaaagagaaagtaactgaggtttacagaaaagtccgggcttcaaaggccgatagtacaagttcaagttcgtcattgtactactttgaatccatgacctatcgcgcattacacaaattgtgttttggtgtaaacggcaatacttttttgccggaaatccagaaagaactgcctgaatataacccaaacaaacaaagtgactttggtgaattctgtttccataaaagcaatactgataaagaaattgatgaacctaaactaatatccttttatcagtctgttttgaaaactaattatgtcaaagacaatctgaacctgcctcaaagtgtatttgatgaagcaaccgtccagacatttgaaacaaggcaggactttcagatagctttagagaaatgctgttatgcaaagaagactatcatttccgaaactttgaaaaaagaaatattagaagacaacaatgtgcaaatatttcaaatcacaagtcttgatttacagaggtcagaacaaaagaacctgaaagcacacacaaagatttggaacagattctggacgaaacaaaatgaaacggctaattatgatctgcgtctgaatcctgaaaccgccattgtctggcgaaaacctaaaaagacaagaatagataaatatggagcaggaacatcattatatgatccgaaaaagcggaacagatacttgcatgagcaatatactctttgtaccacggttacagacaatgctttgaataatgaaattacttttgcctttgaggatacaaagaagaaaggcactgaaatagttaagtataacgaaaaaattaatcagacattaaaaaaagaattcaataaaaatcagttgtggttttacggcattgatgctggcgaaattgaattagcaacgttggccttaatgaataaagacaaagaaccgcaattgtttacagtttacgaacttaaaaaatcggacttcttcaagcatggatacatttataacaaagagcgtgaattggtgatacgcgaaaagccgtataaagcgattcaaaatctatcctattttttaaatgaagagctttatgaaaagacattcagagatggtaagtttcaagaaaccttcaatgaactgtttaaagaaaaacatgtatccgcgatagatttaacgacggcaaaagtgataaatgggaaaatcattttaaatggcgacatgatcacttttttgaatttgaggatattgcacgctaagcggaaaatatatgaggaactgataataaatccgcaagctgaattaaaagaaaacgaaaaagaatattatctgtattttgataaagagggaacagaaaaagttgaaaagatttatcgaagcagattggattttgaacatattaaaccctatcaggaaattagaaatgacctgaatgcctattttaaaaatgttcaaaaaaatgaagcaaaagtggaagatcaaataaatcaaacacgaagagcgcttgtcggaaatatgataggcgtgatttattacttgtatcaaaaatatcggggcattatttctattgaagatttaaaacaaaccaaagttgaatcggacagaaataaatttgagggcaacatcgaacggcctttggaatgggcattgtaccgaaaatttcagcaagagggatatgtgccgccaattagcgaacttattaaattaagagaacttgaaaaatttcctttaaaagatgttaaacagcctaaatatgaaaacatacaacagtttggaattatcaaatttgtaagcccagaagaaacaagtactacttgcccttcttgcgagaaaaaagcttatgaattacaaaaagaaaagaaaggagaagaaaagcccgctgaaaacaaacgatatgaagcggataaaaaggcaggagttttctgctgtccaaaatgcggttttcataacagaaccaatccaatgggatatgaaagtttggatagtaatgataaagttgccgctttcaatattgccaaaagaggatttgaagacttgcaaaagcacaaataa

SEQ ID NO: 88 - DNA, 3264 bp, Unknown
  Metagenome-Derived Sequence
  misc_feature (1)..(3264): Unk20 Csm1 gene
atggatagcataaaaaaagatcccaaagaagcgatgcctcgttttgaaaccgtgcgaacggtgcgttttgaattgaaaccgtcggctgataccctggaaaaactaaaagccgtccttccaaggggggattttcaagtagacatagaaaaatttataaccggtttgagaaaattttattccggactggccgatatcattatcgacaaatcggaagaaggatttgcattgcgaaggggtatagaaatcaagtacggatggctaagaagttataccaaaaatgatttttacacattcatagaaggcggcgatggtagattgccgataaagtatgggatttcagatgtcggatatttgaagagagagctgcaaaggtggtttgtggagtggaaagagataattctagaattggaagggatgattcaggcaccattagaaagccagcgtaggaggcgggattttgcccaattgataagaggtctgaagaagaggcagaattttgaatttattagggaattttcaaaggctctttgcaataccaacgaccctgcaaccgatcatttgattgaagatttgcgtatttccattaatagtttggagggagagcttcaggaggtcgaggcggcttttgcatcttctcagagtgccggttttcagatagctaggggcagttttaactactacacgatcaacaaagatccaaagtctttaaaaaccgaagaaaaagaggaaagggataagttgaatcgttcattgtcttcttttaaagacaaatttgggagtcaggaattttttttaagtggaaagttttcttttattgacgcagcgacaggagagggaaggaaagaggattctgcctcttggacattggaggaatcgtacgggaaattgaaggaatggaagtccgggcagaagaagaagtttttggaggcaatacaggcaaaaattattacagtcggaaatttttcgtcgaagtttcctttatttgaatcttccaaagaagattttttggcgtttttagacctttcagaaaggatggcagaagctaataagaaaaaaagccgtgaagagaatgaaggcaggaaaaaggaaatagataaagggattaaacaactagcacaacaaagaggtgaatttttcaataaaccgggcaagagagtgcaaacaagaaagtactacgatatttgtcagatttttaaaaatattgcgtttaaaaggggagggatagtagcaaggataagcgggatagggaacgagaggagagagtctcaatctttgcaatattgggcgctaataatggaggagcagaaaaagcatttcttgataatgataccgaggggtgaatcggagaattataaaaaagcgagagaatcgatcgagaaaaggctcgcggaaagaggagagataaaaatatatcatttcaagtcccttacgcttcgtgctttggaaaaactttgttttaaagaaatcggtaacacttttgctccggaattaaagaagcaaggcgtcagatttccaaggtataaacaagaatgggggggccaagaggaaaggatggttaaattctatcaagaagttttgacgtcgagctatgcgcataatctattggatattgccgaattcggcgacttgcagtcgttgctgaagaaggaatacaaaagtctagttgattttagatccgatctcgaaaaggccgcttacctcaagaaagaaatatatttggcagatgatgaaaaagaatcgtttttgagaaattacgacgctttagtgttcgagatcgattcttacgatcttaggatagaaagcgagaatcgtcccgagaataagggtcatcaggataaggcccatactcgattatggaaagatttttggacatcgcaaaataaggagatcggatatggtacccgtttgaacccggaagtgaaggtattttggagagaggcggatgaggagttatccaagagtttaagtagcggtaagatatcacagcctagaaaactggactatttccgcaatagatattccagaaatcattttaacttggctattactattacttctaacgctatcgaaagaaagaatgacctggcgttcaagtccattagcgatatagaaaaatatatccaaaattttaacgatgactttaataaaaatttcaagggagagtggttttacgggattgataggggactgaagcagttggctacgctttgtatcatgcgattttccaaacagtcctatcccataaacggaaagtcgctttcctgccctgaattttctagaatagaggcctggcaattaaaggatgagaattattccgaggatgtaaaaagggaagacggaacgcaatttagaaggagcgccataaagaatttatcctattttctagacaaggctgaactgttcgagaaaaaaatggtttcttgtatagatcttacaaccgcgaaaatgataaaaggaaagatcgttttgaacggtgatctaatgacatatttcaaactaaaagagcatgcatcgaggagaaaaatattcagtcttttttcggagtcaaaaattaatgatagctcggagataaaaataagcaagagcgggtcaacgatcgttataaaggacaattgccaagaatatcagccgatttattggattagtcaaaggcaggagaagaagacaaaaggtatgtatagagagattgaaacccccgaacaaattataaaaaaattagacggatatctcaaagatattggccggaacaatataaacgaggacattattacggttgataaaattaatcatttacgcgacgcgatcactgcgaatattgtcggagtggtttcgcatctgcaaggattattccctggcattattgccttcgaagatatggatgaagaagaccacatctctaaacatttcactcagagcaatgaaaacataagccgaaggcttgaatgggcattttataggaatttccaggttaaagggcttgttcctccacaggtaaaaagtacaatctttttgcgaaaggaatttaaagataagcaattcgggatagttcagtttgtgaaaatggagaataccagctgcaattgccctagatgcggagagaaatttccaaaaacatcggatcatcgtcattacatctgcggcaatccgggctgcggtttttcttcgttgggcaataggatggagttctctcctcttgacgattccgataaggtggcggcctttaatgtggcaaaaaatgctttcaataaattgtatgagatttaa

SEQ ID NO: 89 - DNA, 3315 bp, Unknown
  Metagenome-Derived Sequence
  misc_feature (1)..(3315): Unk21 Csm1 gene
atgaaaaattataaattaactaaaaccatccgttttaaattagaagcagacgaaaagaatatttcagatattaaaaaagaaatcaagagtattgaagcaaaaagtaatgagtttgagctcgctaattttgttactgagttgaataattatatagctaatatcaaagcctatttgttttatcaaagaaaagacggtttatcggctataaaagataaaatgaccataaaaaacgaatggctacggcaatatgcaaagcaagaacttgtagaatttaaagttaaaacacaaaagtcaaactatacagggaataaacgtagagaacaaattacaatcagtgaaatcagtgaattatcacaaaaaattacaaaagcatttgatgaacttgttgttatctatacagagcttgcagatagcgcttctttggaattgaacgaaagagcaagaaaagcaaaaataggattgttactgaaacgtctatgtgcaaaaaatactttgcccttattgtcttcgctcatagacaacacatccgacaaaaatgaaactgacgacttaagtatccggctcaaaaaacaagctatcaaaatcaatgctcaattattggtcggcattcggatgtatttgccggaacagtccggaggtttacccataaccaaagcaagttttaattattataccattaacaaaaaacctgttgatttcaaagaaaggatagaggatttggaaaaaaaattggaagttcaagatttggaaaaactcaacatttattttgataagaaaaaaagaacagaaaaagactaccttgaaaagaagatatttaagttgcttgaagccgatgttcaaaaatcattaccaaaaaaccaaactctttgtcttggtgaagcgccaatgattaaaactgattccgttagtttacggcaatttttaaaaaacataaaagcagaacagaaaaagcaattttccgaattgatgcaaaataatattccatacgaggaattagaaaaaagtaatttgtatctattaaataacatcaagtcggaacaatttactgcttacaaagaaaaaacaaaaaagttagaagaaattgcaactaaattaagcaaccaaaatttatccgaagatgttaaaaagaaattgagaagcgacaaagaaaaaattgcaaaagaacgaggcggtattatgaaagataatttttttgcttggaaatcttttgccaatttctatcgctctattgctcaaaaacacggcagaatattatctcaactcaaggatatcgaaaaagaaaaagcggaatcccaattactgaaatactgggcattgattgttgaagaaaataatacgcacaaactcattctcattcctaaagaaaaagccggcgaatgtaaaaaatggttagaaactcaaatctatatacaatcaacaaataatccaaaaattatttggcttgaatcattaacatatcgaagtttgcgaaaactttgctttggctttgtagaaaacggaaataatgaatttaatcaaaacatcaaagatttattaccaaaagacgaaaatggctataccattaaaggagaatttgactttaaaggagatgaacaaaagaaaataaagttttacagaagagttttgagttctaaatatgcccaacaagtattagatattcctgctgaacaaattgaagaagacattatagaccaatcattcgacagtttggatgattttaaaattgcgctcgaaaaaatatgctacagccgccatgttgtttgtccgtctgatattgtagagaagttgaaacattatgatgcccaaatttttgaaattacttctttggatttaaaaaatccggaaaatgtaaaagaaaaacaagataggtttgaacattttgataaacatcacacacaaatctggaaaaatttctggacaggtgaaaatgagaaaaacaattttaacatccgtctaaatcctgaaattacaatcacttatcgccaaccaaaacaaagcagaattgaaaaatatggtgaacaaaaatcagacaagaaaaatcgatatttgcatccgcaatttaccttgattacaacaatcagcgaacacagtaattcgcctacaaaaattttatcgtttataactgacgaagaatttaagacttcagttaacaaatttaacaagaacctcaaaaaagaaaatataaagtttgcattggggattgacaataacgaagtagaattttctacgcttggagtttatttccctgcatttgccaaaacaacaaatgaagaaaaaattgcagaattaaaacaggttaaaaagtatggctttgaagttttaaccatcaatgacctgaactacaaagaaaccgattacaacaacaaggaaagaaaaattattcaaaacccctcatattttttgaagaaagaaaactatatgcgaacattcaacaaatctgaacaggactatgaaaaaatgtttgcagaacaatttgagaaaaaacatttgctcacattggatttaataacagcaaaagtgatttgcgggcatatagtcgctaacggcgatatacatactcattttaatttacaaatgcgggatgcccaaagattaatttacaaaatgaacgatcatacacaagaagaaacaattggtagaataaaagattttaaaataaaagaaacagaagcaaaaaataaagtgtatgtaaatattgatgctaattttattgacggcggattcaaatctgtttttgaaatacgccctgaattttcaaatatcaagttaaaagaggaaattctatcagagataaaaacatttaatactcgcagcatatctaatgaagaattagatttgaagattaatcatttaaaacgatctattatctcaaatgctataggcgttattgattttatttacaaacaatacaaagaacgatggggtggagaaggtttaattgttaaagaaggttttgatacaaaggaagtagataaaggtatcgaaaaattcaacggaaatatttatagaattttggaaagaaaactctaccaaaaatttcaaaattatggattagttccgccaattaaaagtttaatggcagtaagggctgatggtattaaaggcgacaagaaagctatattacgattaggaaacatcgcttttatagatccgacaggaacaagtcaagaatgtcctgtttgtagtgaaggggaattagatcatactaccacttgttcaaaaaattgcggctttgaaagcaatgggattatgcactccaacgatggcatagccggtttcaatattgccaaacgtggttttgaaaatttttattga

SEQ ID NO: 90 - DNA, 3369 bp, Unknown
  Metagenome-Derived Sequence
  misc_feature (1)..(3369): Unk22 Csm1 gene
atgtctacaataataaccgctaaacagctagaagctctcgctgatatttatcaaacaagaaaaacaatcagatttaacctactaccagtaagtctttctcacaagaaaacctccgaagatgagtttaaaatagcactgggacaactcatagaaaactacaaacaagtcgttaacaatttcaacgacacggtattttcttgcgagaatgagatagaaatactaaatccgcgaatcaaaatcaattgcaggtggctaaaagtgtatacgaaacaagatttttaccaaaacgcactacgattaaaaaacaagaatatagatttaggcgaggccgatttcttgcttgaaattttccaagaatggtcaaaaaggaactggtcagaagaagtatgtacagaaatcgaaaagcctggaatcttaaacgagatagaggaattaaaaaaccagccgctcaactgtcagaaacgaaaagcagattttgcatattgggtccatcagctgcaaacaagaaataattttccttttatccatgaactttttgaaaatataaatgatgaaatgggtggcgaaaatgacgaacgcatagcaaatacaaaaaagatattagatatctgcgaaggctgtcttaaaaagattgacgactatctgctcccgagccaatcgctggggcaagaaatagaaagggcaagtttgaattactacacgataaataaagagtcaaaatattatgaaaacgagattaaaaacaaagaaaaaaccctagaagaaccaccaacgagcctccgcttttacaaagatacaaattttcttaagaatatatcgaaggatctaccattctttattgaaagcctcaacaaaagcattcccgagaatgcaaaatttatagccagcgtaggcgacccaaataaggcagagaattggtcactagcccaggcttatcaaattctgaaattctataaaggaaaacaaaaatcgaatctgatggagttcgtttcgcaaaaaccttccttctctgaattgcaaaaagaaaaggggttgtctctcatgaaaaaaataaaagacaaacgcagaagtaatgagcaagtattccaagattttattactcttgcaaaagaaattgagcagttaggtacggaaaaattcagattggatataaattcggaaaattatcctcagcaaagtatagctctacgcaaaaaaattaaagaaacgactcaaaaaagaaataaatatttcatatacaatttcaccgaatatatcgattttcacaaaggttttgatgagatcgcgaaagaattcggaaaaatcaacgcggatatcaaaggactgaaaaaagaaaatattgacgcagaaagattgaggtcatgggctgtaatactggaaaaaaacagccagcattaccttatgacgattcccaagaaagacggcaagctccccgaagcctatagggagatcaaaagccttcgatcggaatcaggagaaaatctttggactctatcagttttcgaatccctaacccttagagcgctcgacaaattatgtttcaagaagatcgacaacacattcataaaaagcatagaaaaagaactaaggggaaaatgtccggaatattttaagcgtggaaaattcatgcttaaaagcgaatttaaagacggacaacctcctgcagaattttatcaagcaatcctttctcttgagacaaccgaaagtgtcatcctggtcaacgaatatttaagagacgagaaaagagacatattactcgaaaaaaagttcacatcgctgcaaaacttccagtccgagatggaaaaaatctgttatatccgcaaagaaatcaaaatttcccaagcaacaaaagaacatctggaacaaaaatacgatgccgatacatatcaaataaccagctacgatctggaaaaggaacgccaaaaccccgaagagcatacaaaaatctggaaaagattctggaatcagaataaaaagagcggatatgtaactaggctgaatcctgaaatgataataaattacgtggaacaaagaataggcagcataaaagacaaaggagaaaaagaagtaaaaagaaacagaagaaaacaggcagaatatattctggcacttacaatcacggaaaacaatgacaaaccaaaaacagatatggcgcttgcaagcaaggatgctgtgaaaaaagacatagaaaaattcaataccgagcgtaatctcatattaagcaacgatccatacagcttctactactacggtatcgaccgcgggcaaaaagaattgattactctgggcgttttcggttttgagaatcaagatatcgccgtgtcggggtgggacaagaacggaagcctgatcagtaaaaattataaaaaaccacgaccagtcacaatagaggcttatgaactaccgcaggaaaaattccttgaagaaatagaatacacggtatcaaacggagagacgaggtctttcgatgcctataagaatatatccctctgcgaacatctgctggtaagaaaagatgttgactcctgtttggatttaagttgtgccaaacttatcaaaggaaaaatagtcgtcaacggagacatctcaacttatttgcaaatcaaaaagacggcggcaatgagatatatcacagacggcctggctcagcaccaatttacaaacgtgctaattcaagaaagagaaggcactctgtgtcttgaagaagaaaagagaggaataacgacattggtagagctataccatttcgacagcagattcgacaatctcgtagaccgcgccaacctaaaaacagaattacaagaacatttcgacaaaatacgagaagaaaactcgcaaggagacatatacacgattgagaaaataaatcacctgcgcgatgcaatctgcgccaatgcagtcggaatcatcgtccacttactacaaaaatatccgggtctgattaccttagaagatttagacatcgagcataagtcaagagaatttagcaaatactacggagatgtgggaagcagaattgagatagctttcatcaataaattacaaaccctcggacttgtgcccccgagttgcaagatggtaataggtatgcagagcaaaaaagagattaatcaactcggcattattcactatgtcaaaactgacggcacaagtggcgactgtcctcattgtggtcaaaggattgacaaaaaaacaaaggatactaataaatggggcaagcaccaatttaaatgcgataacaatggcaaatcctgcggtttcagcacatatgaggacaaggatcataaagaactggattttttgaaaaactctgatgacgtagccacttacaacatcgcaaagctaggttttgaatctatagtggtttag

SEQ ID NO: 91 - DNA, 3393 bp, Unknown
  Metagenome-Derived Sequence
  misc_feature (1)..(3393): Unk23 Csm1 gene; TGA encodes Gly
atgatgaataatattgaaaataaaaacttatatgaagttaggaaaactgttagatttgaacttgaaccacaatttaaatttaattatgaaaataaagatattgtaaataataattttgatttaaataattttattgataaatatagtagttttttaaaattatttaatgaaatagtttttaattttaattgagaaaaattaaattgaaaattaaagataaaatacagctttttaaagagttatacaaaaaatcaatattatgataataaaataattaaacctttaaaattagttaatcaagttgaaatatgaagttctaaaaaatttgaatatttgtttcaaactttttctgaattgtataaaaacaactttgatattttaaataatataaaagaattatcacaaagaagtttagaaaatcaatctagaaaatctgatttagctgtttattttagtgaattatcaaaaagaactaattttgtatttttatatgaattatttaataatagtttaaatattgagaatgatgaagtatcagttaaaattgataaagcaaatattttaactaaagagattgatgaacttataaaaaaaattaaaaaatcattattaccaactgaagtaattgaaaaattaagtttcaattattatacagttaataaaagaaaaaaagattatgataaagagatagaaaataaaataaatgattttagtatacaattaaaagattttaatccaattttaagtatcactcatagttgatttaaaaattatatttctgatattgctgaaaaatcaacattattaaccatagttgattgatacaatttaatgaaaaaatataaagctgaacaaaaatcaaattttttaaaatatttatactcaaaatctagaaatgaagattgtgatttaaatattgatttattttctgatattttaataaagcctgaatttaatgaaattttagacttaacaaaagcaataaatattttatcacaagttaaaactgatattttaaatctaaaagaagctaatgataagaataagaaaaattttgaaattgaatcaactttagaaaaatataataataatttttgaacagatttttgaaaaattgaaagagataatttttttgaaaaaattactaaacttaaaaaattaagatgagattatttttttgaatgaaataaagaaaaatttaaatttaatgactataaaattttttgctcagaatataaaaaagttgcaaaggaatattgaaatattaaagctaaaattaaagctttacaaaaagaaaaaattgatgctgaacaaactcaaagttgggctttgattctagaagaaaataataataaatttttacttacaattccaagagataatacaaataattctgaaaatctatctgaagcaaataagaaaattaaatatttgccttcagataaaaattgagatatttacttaaatatatttgattcacttactttaaaagccttagataaactttgtttttgaaaagaaaataatacttttagaagaactatatattttaacaaggctgaatatccagaattttttaatgataaatgatttttaaaagataaatttgaattttcaaatttagtaaattgacaaaaaattaatgatgaaaaattacttataaaattctataagtcagtattggctttagaatcaacaaaaagacaaattagtttaaaattttttacttgaattgaagattttttacaaactaattttgatactttagatgaatttcaggaggaactaaaaaaagtttgttataccattattagaaaaactataacaaaacaaacaaaggatgaaattataaataattatcaaacaaaactttataaaattacaagttatgatttaaaaaaatatgatgaagattttataaaaacattgaagtataaatcagatttaaaaagaaaaaaaataaataatcatactcaaatatggcttgatttttgggaaaaagaaaataaaaataataaatttccaacaagattaaatcctgaaataaaaattagttttactcagttaaatctaaagtttattcaaagtaactctgaattatttacaaatagacattttggaaatagacttattttaacttcaagttttactcaaaatgctttttgaaaagatttagatttaaattttaaagaaactcaagatataagtaatttttatgaaaaatttaataataattttaataaaaacatcaagccaactttaaaatatagttattgaattgatagatgagaaaatgaattagtaagtttgtgaatttttgatttatcaaaagataaaccagaagaaaaatgagtcaaaatacctgtttatgagttaaaaactgataaattttttgcatatacaaaaacaacttctactggaaaaaatatgtttccatatcaaaatgtatcgtattatcaatatgaagattttccacattattataatgaaattaaatatgtttcttgtctagatttatcaacggcaaaacttattaataacaaaatttatctaaattgagatattcaaacttatttaaatttaaaaatagtttcagcaaaaagaaaaatttatgaaataatttcaaaatcacaacataaatctgaaagtttagattatgatgattataatacaatgatttatattgattgaattaaagggaaaaataaacatatttataaacataattcaaaatatgaaagtattttaagttttgattttgtaaaagatgaacttaaaaaatatattataaaagtaaaagttgatttaaatgataatgaggaagtgtcaatccaaaaagtaaatcatctcagagaagctttgtgtgccaatatggtgtgaataattgattttttacaaaaaatatatcctggaatgatctattttgaagaaaaaaatgaggatgatagaataaatcattttaatataagtaattctagtttaggaagtaaaatagagctaaaattattacaaaaatttgcttcaaaaaattttgtaacaccagtttataaacaaattttaactataaaagataataaaaagtataatattaaacaactttgaattatttgatatgttgatgaaaaaaatacttctgattcatgtccaatttgttgaagtaagttattttgacattgatcttttgaatttgaaaacttaatgcatcattatactgaaaaatattgatataattactgagatagcttagataaagctaaaaaaactacatatgatatttgtgattatcatatgaacgataaaaattattgatattttttcataaactcttgagatgatttagcaacttataatattgctaaaaaatgaattgaatatttaaactctaaaaaataa

SEQ ID NO: 92 - DNA, 3501 bp, Unknown
  Metagenome-Derived Sequence
  misc_feature (1)..(3501): Unk24 Csm1 gene; TGA encodes Gly
atggaaaataataatatgtttaataatcttaaaaatctttatgaattaagaaaaacaattagatttgaactagaaccttatatcataaaaagaaatttaattccagataataatgttaatgaaaatttattgaaagaattttataattcatacaaagactttataaatctacttaaaaagaacttttttaatgataaaaatataatatgagaagaagataaagatattgagaataaaccttttgcaaacttatttaaaaaagcatgaataaatatagaatgaaacaatcaaagttgaaaccaagatattgataaagatatttatgataattatgaatggtataatacaattcaatttaaatataaatggcttgaagaagtatttctaaatgaatggatagataataaagaaaaaatcaaatataaaaatggagaaaagaaacaaaaaaattatattactttttgagatttatgagaaaataattttgtaaaaaagttttttataaaattttttaaagatacagatagtaatttaaaatctttagaacaatatttaaataattgattagaagatcaaacaagaaggtcagatatattatttttaatacaatctataaattcaagagattatttatgaaagttatatatattatttaagaaagataacattgaccataaaaatgattataatattattaaagaaatgaaagaatctattttacaattggaaaaacttataaaacaacttttaaataaacttaaacctagtcaagcattttgacttcctatagaacatataagtttaaattattattcagttaataaaactcctaaagaaattgatgatgaaataaaaaatgagcttaataaaaagaataatatagataaaaaatatatatggacttttgaagacaaagataatttaaaatcgatgttttttaaaagtacagacaaagaattggaaaaagaattggaaaaagaattaaaccaagaaatgagtttaaaagaattaaaacaaaaaatcaaactttttaaagcaaaacaaaaagcaggttttttagaattattacaacaaaaaactccttttaaaaatttcacaaaaccttttgattttaaatttatgggagaaagttttgaaaaatttaatcttgttcttttctctaaaattaacgaagatacttataataaaatgttaaaattgacagaagaaattgaaaaagaaaataataaagcagaaataaaaaaattaaaattgaaaagatgaaaattttttcaacgggaattaaaacaatttaaaggattttgtgatgcatataaaaaaatagctcaaaaatattgacaagctaatgcaaaaattaaatcacttaaaagtcaaaaagtagatgctgaaaaacttagatgatggtgatttttatcacaaaagaataatgattattttataaatacttttgatattgaaaactcaaagaatgtttttacaaaagaaataaaaaacttaaaagaaaattgaaaagatgttgttatctatattttatcttctttaactttaagagcattagataaattatgttttaaaaaagattctagttttattaaagaacttattaataatattgatgataaatttatcaatactaataataaatataaaaaattaaagtctaaaaaacaacttttagaagaattagaagaatgagaacttataaacttttatattgaaattttagaaaaacaaaaaactttaaatatcaaatatagaactgaaaaatctttagatatactaaaatcatcaaaaaatttagaagaatttgaaataaatttaaaacttgaaacttatcattttatatcaaaaaaaatatcagaagaaacttataatagaatattaaaagaatataaatgaaattcttataaaataacttcttatgatataaaaagatgaaaacaaacaaaaaaatatactacttggtggtttgatttttggaaaaaagaaaataaatataataaatatattactagaataaatcctgaaatgacaatttcttttaaagaaaaagataaaaactttatagaagataatcctgataaaaaaagaaatagaaagtttaaaaataggtttatattagctactaacttttccttttatgcagataaatattatatagattctgcatttattaatgaagaaaaaagaaaaaatagtatagatagttttaataaattatttaatcaaaacaataaacttaaatatatttattgattagataaatgaacaaaagagcttataactttatgaatttatgaaataaaatgagaagaattaaaacctgtaaatatttctgtaaaaattcctttgtataaaattacaaaaaagtgatttaaatattttgaggagatagaaaataaaaattgagaaaagaaaaaaagatatttagcaaaaaatgtttcatattttataaaagatttagaaaataaagaattatttgaaaagttagaaataaattcttgtctatgagatttaacttatgcaaagcttataaagtgaaatattattttaaatgctgatatattcacaactttaaatttttataaaataactgcaaaaaggtttttaaatgatgcaattacaaaatgaaaaattgaatgagaaaaagttttttatattgaaaaaaataaaaatttttattataattatgaaaatagatcagaaatagaaaaaaaagttataatttatcggaaagaagaatttgattatttaccttataatgaacaatattataatagtttaatagaagaaatagaaaatgaactaaatagttatattaagaaaattcaatcatctttaaataattcaaaaaaacatcatgataatgaagatatttcaattcagaaaataaataactataaaaatgcaatttctgcaaacattgtttgaattattattaaattacaagaacattttaattgatatatttgttttgaaacacttgatgaatgacaaatacaaaaaaaatgattaaaaacttttattggtaatataataaatgaaaaaatttataatagattacagttaaatctagaagtgccacctattttaaaaaaatttagaactgatgtatgaaataaaaaaataattcaacatggaaaagttatttatattaatgaaagcaatacctcaaaagcatgtcctatatgcaataaaacattattagaagtagataaaaattgaatactaaaagaaaaagatggtaaagatgataataaaatttataaattatactgacatttaaagagaaaaaatgaaaataaaatgcgtcatttatcagataatgaaaaatttcaaccttgaaaaatagaaataaactgaaaaattgaaaaaatttgtgattataatatggaaaaaaataattattgacttgattttataaaatcttgagatgatcttgcaacttacaatatagctaaaaaagcattagaatatttaaattctaaaactaataattaa

SEQ ID NO: 93 - DNA, 3504 bp, Unknown
  Metagenome-Derived Sequence
  misc_feature (1)..(3504): Unk25 Csm1 gene
atggagaactttcaaattagaaaatctttaagattcaaacttgaatctaatgaaaacaacaatttaatcaatgaaactactaatcaattaagcacaagacaagattttgatttgtcaaacttttcaacaaagttagataactttcttaatgacttaaccgactatctattctatgaagacaaacaaggagatttgattataaaaaaatatttaatcttaaaaaacgattggttaaaaacatacgctaaacaacaattctttatttgcaaaaacagtaaacaaacaagaggtaatcaaagagttcaatttactattgaggattgcgaacttgaagatatgattaccgaggttcgtgagaatgtttacgacatttgcgatgaattatacgaaagatcaagagcagatttgcacgaaagatataaaagaagtggtattgcggtgcttttaaataggcttaacacaaaagataacttaccttttttggttgatttggtaaaactatctattgacaaaaaagaaacaagtgatttaagcataagattaaaatcggctggtgaagagttattaaacctactcaaacaagcaatagagcattttcttcctgaacaatcctcgggtatgtgcattacaaaagcaagttttaactatcacaccataaacaaaaagccgatagattttgataaggaaatcaaaaatgttgaaagtagtttacttacttcaagacaagcacaagaaagaaataaaggagggattgacaacaatgtttggaaaactgcttggatagatattaatataaaagcaaatggtttgccactttgtcttggagattctccttttatggaagttgattcttatgcaagtttgcgtcagatattgaaaaatattttggcaacgcaaaaatctcaattccaagaagcgatgcaaagaggggattcttaccgtgagttaaaggaaagcgacttatatttgtttaacaacataagcgaagatgaatttaataagtattttgagtatacagaggagattgagaaacttgcaacaaagagaaatcaaacccatgactacaaattgaaaaaagatttagcaagcaaaatagaaagattaaagagagaacgtggtagtttgataagcgaggcagatagacgaaatactaattatttcagaacatacaaagagtttgcaaagttttatcgtaaagttgctcaatctcacggaagagaacttgcaaagttacttggaattgaaaaagaaaaggttgaatcgcaattattaggctattgggcaatgataattgaagaaaagggagaacacaaacttgctttaattccacgaaaaaagacaaatgacttaaagagacgtttagaagaatctaaaaattctaaggaagaggttaagctttattggtttgaaagtttcacttatagaagtttacaaaaactttgctttggaaaccttgaaaccaacactaatactttttatccagaacttagaaaagatggagcgttacttagaaaattctctttacaagataggaatggttatcctaaattcatatcaggcgagcatgaatttaagggtgatgaattaaaaaagatagatttttatcaatcggttcttgcttctgattgtgctaaaaacaaattgaatttaccatacgatgaagtttataataatgttgttaataaacaatttgacaatttagaagatttcaaaattgctcttgaacaagtatgctataaacgttgcattactactaataaacacttgattgacaatttggcaagcgagtttggtgctcaaattttcgatattacaagcttggatttaagaagagaaagcaacacaaaggacaaagcggaaaaatatacttacaaagaaaaacgcccaacagaactttggagagaattttggaaagaagaaaacgaagaaaaaggatttgacataagactaaaccctgaaatcagcattatttatcgcaaggctaaggaaagtagaattgaaaaatatggtgcagatagcaagaaaaataatcgttatttacacgatcaatacactttggtaatgacttttaacgagcattgcaacactcctacaaagaatcttgcatttgctaacatcaatgacgagcaaaaggttattgaagagtttaacgaaagattcaaaaaagagaatattcgttttgctttgggaattgacaacggagaggttgaactttctactttgggagtttattttccagagtttgaaaaagagagcatcgaagagaaattagcggaactacgaaatgtagaaaagtatggttttgacactttaacaataaaggatttaacatataaggaaacagacttaaaagataaagacaaaaagataatagagaatgtttcttatttcttaaaagaggatttatattgcagaacctttggaaagacagccaaagaatataaggaaatgtttgaaaaggtatttgaaaagaaacgtttattaagtttggatttaagtgctgctaagttggtttgtggtcatattgtaacaaatggagatgttaaggcgttgtataatctttggttaaagcatgctcaacgcaatatttatgatatgaacgatcattcaaaaagagagggattaaaaaaggtagatttcagatatagtgaggacttaaatactgaggaaagaagaatttttattgcttatttgaacgaaggaaatgataaatataataaactttctaaagaagaaaagaatgcgtatgttgattggttatatgaggcttgggcagataatgaaatagaaaacaaaaaattttataatgtttataaagaacaaaaaataaagggtgattatcttcataatgtacttttaggtgcaacctatattggagaagaattgcaaggtgtagaagaaattgctaacattgatcatatcagacacgtatttaagtttagagaagactttgaaaaaatatttacaagagaagagataaagaaagcaattgactcttataataaaagagagatttcaaatgaagtcttggatttaaacttaaataaagcaaaatcttccattgttgctaatgttattggaattgtagattttctttacaagtattataaaaatagatttggtggcgagggaattgttgttaaggaaggttttggtataagtaaggttgagggtgatagaatgaagttttcgggtaatatttacagaatgttagagagaaaactctatcaaaaattccaaaattatggtcttgtgcctcctgtaaaaaacattacagaatttagaggcaaagacaacgcatttgtagaattcggaaatatttgctttattgattatagtggcacaagccaaaggtgtcctatttgcgaaaaaggaagattaaatcatacagaaacttgttctgaaaattgtggttttagttcaaagaacattatgcattcaaacgatggtattgcaggctacaatatcgcaaaaaaaggttttagagaaataacaaaaaaatag

SEQ ID NO: 94 - DNA, 3507 bp, Unknown
  Metagenome-Derived Sequence
  misc_feature (1)..(3507): Unk26 Csm1 gene
atggaaacctataagattaccaaaactatacgctttaaattagaagccgatgaagagaacagcatccacattaaagaagatattataaatattgaaacaaatgataatgaatttaccatggttgattttgtttctaatttgggcaattatatcaaagatctcaaaaactatctgttttatgaaaaaaaagatggttctttgtctttcaaagacaaaattatcattaaaaacgaatggctgcgtcaatatgcaaagcaagactttgttgagctaaagtcaaaaaaacgaattaatttaagaaataaccgcatggaacaaatcaaaattggcgatattccaagattatcatcaaaaattgaagaagctcttgacatagctaaggaaatttattcaaaactttctgacgacgcaactttagaacaacatgaaaggacaaaaaaagcacaaatcggactattattgaaacgtttagaagcaaaaaatgtactccccttattaatggatcttgtaaaagaaacattagacaaagacgagactgatgatttaagcataaggcttaagagacaatcacaaaaaattaacagtcaattaaaaatcgctattcggtcgtttttgcctgaacaatccaacggtttgcagattgcaaaagcaagttttaattattataccatcaacaaaaaaccgattgattttgaaaagaagatagaggatttgaaaaaaaatctaaatgttaaagatttagaaaaactcaacgtatatttcgacaagaaagagaaaaaacaaaaaaactatcttggaaaaaaaatatttagtttgtttgaaaccgatattcaaaaagcgctatcaaaaaaccaaccactttatctcggcgatgctccgatgattgattccgcttatgtcagtctgcggcaaatttttaaaaaaataaaatcagaacagaaaaaacaattttcagaattgatgcaaaataaatgttcttatgatgaattaaaaaacagcaatttatatctattgaatgatataggtttggaacaatttaatacttacagagaaaaaaccaaagaattggaagaacttgcaacaaaattaagcaatcaaaatctactagaaaacgcgaaagaaagattaagaagccaaaaagagaaaattgcaaaagaacgcggcaatattatgaaggacagatttcaaacatggaaatcttttgccaatttctaccgaactgtttcccaaaaacatggcaaaattcttgctcaactcaaaggaattgaaaaagaacaagctgaatcacaattgctgaaatactgggcattgatttgtgaaaaagaaaatcaacatcaactttggcttatccccagagaaaaagcatgggaatgtaaacggtggttagaaacagtgaatgatacatccatagacaatgagaacagtatcaaattatattggttcgagtcactaacataccgcagtctgcaaaaactttgctttggatttttagaaaatggaaataatgagtttaatcaaaacatcaaagatttgctgccaaaagacagaataggtaacaccattaatggagaatttgcctttgaaggagatgaagaacgaaagattgaattctacaaaacagttcttaattcaaaatacgccaaacaagtactgaatattccctttaagcaagttgaagaagaaattatctcgcaatcctttgagaacttgagcgattttcaaattgcactggaaaaaatatgctaccgtcgttttgcaatttattcaaactatataataagtttcgatgcacaaatttttgacatcacatcgttagatttaaaaaacaacgaaaaaaacaatctcaacacccacacgcatatttggagagacttttggaaagatgaaaatgaaaagaataactttgacattcgtttgaatccggaaattacgatttcatatcgtacacctaaacaaagcaggattgaaaaatatggagaaaaaactaaagaatacgacccaaacaaaaataatcggtatttgcatccgcagtttactttaattactacaatttcagaacgatctaattcgcaaactaaaaccctttcatttattgaagatgaagattttaaaaagtcaataaacgagtttaacaagaaactcaaaaaagataatattaaatttgcttttggtatcgataatggagaagtggaactttctacacttggagtttatttgccaacatttgaaaaagaaacccatgaagaaaaaatttacgaactgaaacagataaaaaaatatggttttgaggttttaaccattactgatttaaagtacaaagagactgattacaacggaaatgtaagaaaaataattcaaaatccatcctattttctgaaaaaggaaaactatatacgaacattcagcaaatccgaacaggaatatgaggaaatgttcgccaaactgtttaaaaaagaacatgtactcagtttggatctgacaactgcaaaaatgatttgcggacatatcgttaccaatggcgatgttcccgctctgttcaatttatggcttaaacatgcgcaaagaaatgtttttgaaatgaacgaccatacagtcaaagaaacagcaaagacaatcagacttagaaataatgaagagttgacggataatgagaaagaaaaatttgcagagtttatttcagatggtaaaaaatttgccaaattgaccaaggaagggaagaaatcaaggtatctaaaatggatttttgaagatcggaaagaaaatagttttaccgaagatgaaaataaaaaattcaatgactgtcagaaaaaaaaaggaaaatacaattcacatatcatttttgcatcccgttttgagggagatgaattgaaaagcgtgactccaatttttgattgccggcatgttttcaaaaaacggaaggaattcgaaacaattagaccaatcaaagaaatcgaaaatgaaataagcagattcaacactaatcgtacaagtcacaacatttcaaacgaagaattggatttaaaaattacagatgccaaaaaggcgcttgttgcaaacgcgattggcgtcatagattttctttataaacaatataaacaacgttttaacgatgaaggattgataataaaggaaggatttgatacccaaaaagtagaagaagatatagaaaaattcagcggaaatatttaccgaattttggagcgtaagctttatcaaaaatttcaaaactatggcttagttccgccaattaaaaatttgatggcagtaagaaacgaaggcattaaagacaaaaatgccattttgcgtttgggaaatattgcttttattgatccttcaggtacaagccaagaatgtccggtttgtaaagaaaaaagcaaagaaaaacatactaataattttatctgcgaatgcggatttaattctactaacattatgcactcaaatgacggtattgctggattcaatattgcgaaacgcggattcgaaaattttatcaatgaaaaatag

SEQ ID NO: 95 - DNA, 3516 bp, Unknown
  Metagenome-Derived Sequence
  misc_feature (1)..(3516): Unk27 Csm1 gene
atggaaacttataaaataacaaagacaattcgcttcaaattagaagcaaaggacgaaaatattccggaaattcaaaaagatattgccggtttagataacaattttgatttggctaactttcttacgggtctgaatcattatattaatgatattgataaatatttgtttgaaaagaaaaaaaatggcaattctgtcataaatggtaaaataacaataaaacctgattttttgaaaaactatgcaaaacaagaatgggttaatttccaagaaaaaaataaattgacacaaaacgctactcaaaacagcagaccgcgtaaagaacgaaattctattaatgaatttaccggtttagatgaaaaaattaaacaaacattcaaggaagttgctgatatttacgaaacacttgcaaacgatgcaagcgccggacttaacgaaagagcaaaaagagaacataccggattacttcttaaacgattgcaagcaaagaatacgcttccatatttgatttctcttgctgaaaattccaataataaaaacgaaacagatgatttaagtatccaacttaaaaatcaatcatcgaaattagaacagcaattagcggcaggtattcgggaatttttacccgctcaatcaagcggtttgcctgttgccaaagcaagttttaattattatacgattaataaagcaccaattgattttatcaaaagaatagaagaattgaaaaaaaatttgaaagttgatgatttgcaaaaacttaattcattttttgataagaaatctaaaaagaataaactgtattttcatgataatctgttcaaattgattcaaaccgatgtgcaagagcaattaaaaaacaataagattcttttacttggcgatacttctatgcttgatattgaaaattacatcagcttgcgacaagttttaaaaaatataaaatcaactcagaagaaaaaattttcagaatggatgcaaacagacaaaaattatgatgatttaaagaaaacagaattgtatttgtttaaaaatatctctctcgaccaatttattgactatagggaaaagacaaaagaattagaagaattagctgtaaaaatcaatcaggcggcaaacggtgaagaaaggaaatctttaataagtaaaaaggaggctgtcgcaaaaataagaggtaatataatgaaagataaatttgaagcttggaaaagttttgcaaatttttaccgttctatcgctcaaaaacacggcagaattttagcacaattaaaaggcatagaaaaagaacaaacagaatcacaattgctgaaatattgggcactggttttagaaagtaacaatcagcataaactcgttttaattccaagagaaaatagcggagaatgtaaaaaatggttagaagaaaatgacaaccgctcgtcccctggctctcgtcacatattttggtttgaaagttttacttatagaagtttacaaaaattatgttttggaaatcttgaaagcggaacaaacacttttaataaaacaattcaaaatttattactcaaatattctaaaggcaaacctataaatggtgaatttgcttttgaaggtgatgaacagaaaaaaattaaattctataaagatgttttacaaaatcaaactacgcttaacttgccgcaagaaaaagttcagatggaaatcataaataagaattttgcaagtttaggagactttcaaattgctctcgaaaaaatttgttaccgtcgatttatagttcttaattcagatgcagaaaaaatacttttaaataaattctatgcgcaaatttttgatattatttcgttagatttaaaaaatttagaaattatcaataataaacaagaaaaatatttgcacaacgacaaacgtcatacacaaatttggaaagaattttggacaagcaaaaatgaagaaaacagctttgacattcggctgaatcctgaaattataattacttatcgtcaacccaaacaaagtagaatcgacaaatatggtcagaacagcaaattaagtaaccgttatctgcatcctcaatttacgcttattacaacaatttctgaacactctaattcaccgacaagaatattatcctttgttacagatgaagaatttaaaaattctgttgatgagtttaacaaaaaacttaaaaaggacaacataaaatttgcttttggaattgataacggcgaaaaagaactctctacacttgtggtttacttgccggaattttccaaaagaaccccagaagaaaaaattgccgaactgaaacaaattgaaaaatacggctttgaggttttaaccattaatgacttaaactacaaagaaagcgattacaacggcaaagaacgaaaaataattcaaaatccatcctatttcctgaagaaagaaaactatatgcggacgtttgacaaatcggaacgggagtacgatgaaatgtttgagaaactatttaagaaaaaacgtactctcacattgaatttgacgacggcgaaggtaatttgcggacatatcgttactaatggcgatgtaccagctttatttaacctgtggctcaagcatgctcaacgcaacatttttgaaatgaacgaccatatcaaagatgaaacggcaaagagaataattttgaaaaacaaattagacaccaacaaagaaaaactaaaatttgcagaatatatttctcataaagaaaagtttgacgaattttcagaagtagaacaagaaaagtatgtccattggatttttgaagacagagagaaactcgacttcactaccaaggaaaatagtaaattcaatgactgcacaaagagaaaaggggattatagaaccgatattctttttgcctcctgttttattggtgatgaattacgaagtgtaaccgatatttttgattgcagacatattttcaaaaagcacgacgaattctattcaatcaaatcagagaaagagattgcggcagaaattgaaagttttaacaccaacagaacaagccatgacatttcaaacgaagaattagatttaaaaattgtagatgccaaaaaagcgcttgttgccaatgctgttggagtaattgactttctttacaaaaaatacaaagaacgctttaatggagaagggttaattgtgaaagaagggtttggtacaagggaagttgaacaaggtatagagaaattttcaggaaatatttacaggattttagaaagaaaactctatcagaaattccaaaattacgggcttgtaccaccgataaaatctctaatggcgatacgcagtgaaggcttgaaagggaataaaaaagcaattttacaacttggaaatgtttgttttatagccccggacgggacaagtcaaaattgcccgatctgtgagacaaaaatgaataataatcacgcagatgaaatagtttgtaaggtatgtggttttgaaagcaaaaacattatgcattctaacgatgaaatcgccggatttaacatcgcaaaacgcggctttgaaaattttaactaa

SEQ ID NO: 96 - DNA, 3516 bp, Unknown; identical to SEQ ID NO: 83
  Metagenome-Derived Sequence
  misc_feature (1)..(3516): Unk28 Csm1 gene

SEQ ID NO: 97 - DNA, 3564 bp, Unknown
  Metagenome-Derived Sequence
  misc_feature (1)..(3564): Unk29 Csm1 gene
atggagaagtacaaaataacaaagacgattcgttttcggttagatgcggataatactgcgatatctgcaattgtaaaggatacggaggcgcttgaagcgagggggcaggggttcaaaataaaaaaatttgttaatgcgttgggaagatttttgagcggcgatggtgttcagaagtatctgtatgatatgagcaatgaggaaaattgcgtttttaagagaaatttggtgataaagaatacatggctaaaaaacaatgcgaaacaggagattgcaggcatggatctcaaacggggccttattatcaaagacattaaaggtttgcaggataaaattgaagagatatacgataaattatgggaaatttatgaaatattatatgaatcggcatatcttccgctgcaagatttggcgcggcgggagggtatcggacttttgcttaaaaaactcagcgtaaaaaacgcgcttccgttcataatctcttttgttgaggagtccaatgataaaaatgaagcggacgatttgagcttgcggctaaaaaagcagggaaaagagattctaacgcaattggaaatcggtattaacgagtatctgcctgctcagtcaagcgggctgccggttgccaaagcgagctttaactattacactataaataaaaccccggttgattttggtgagaagatacaagaactggaaaaacgtctatcagtggatataaaaaaggaaatcagcagttttacaggcgggatcaaaactgcaattaaaaataaaattgccggcaagaaaattttgcttggcgatacgccgatgtttgaaagtgaaaattccgtaagtctgcggcagatattaaagaacataaaaagcgaacaaaaagcgcagttcaataaatttatgacaacgcagaataatccgcagcttgaggagatgaagacaatggggtggtatctttttggggatataaccgaaggtgaatttaacgattataaagagcaaaccaaagagattgagagagtaggggcaaagataaatcagtgcggtaatatcaaagaaaaaaaagagctgcggtctcagttgcagaagctcaaaaaaaagcgcggtgaattgataagcgaggcgcacaaaaaaggcggcaacgataagaattttaagacatacaaagaatttgctaagttctaccgcaagattgcgcaaaggcacggaaaaatcctcgcgcaaataaaaggaatcgaaaaagagaaaatcgattcggccatgctcaattattgggcggcggttattgaactaagcggacggcacaagctcgttttgattccaaagaaggatgagaatgcaaaaaagtgcatagagtggttagaagatgaaagtaagcataaaaacgggtcgtgcaagattttttggtttgaatcatttacctttagaagtctgcaaaaattatgcttcggaaatcttgacagtgggacaaatacttttaatcaaaaaattcaaaatttgttgccgtgtgatgaacgcgggaatctcatgaatggagagtttgcatttaagggtgatgaacaggaaaaaattaaattttataaaaaggttttacagagccaaaaagatataaatctgccgcaaaaagaggtcgttgataatgttgttggcagaaaatttgaaactatggatgaattcaaaatagctttggaagagatttgttacattcgccgcgaaagactcagcgcaaatgcagaatcagagctcaaaagtaaatttaacgctcaaatttttgatatcacatcgcttgacctgagaaatccggtaaactgtgccggaaaacctgaggtttatcatcacaatgacaagaggcacacagagatttggaaagagttttggtcacttgacaatgaacgccgcaattttaatatccgcctgaatcctgaaattaccataacataccgcaaacccaaagagagccgtatcttaaaatatggcaagggtacagaaaaatataacgccgatatgaagaaccgctatctctatccgcaatatacgcttctcacaacaataagcgagcactgcaacacgccaactaagattttgtcgtttatgactgataacgagtacgaagagtcaattaaagcgtttaacagtaagctcaaaaaagaggatattaaatttgcctttggcatagacagcggcgaaacagagctttccacgcttggggtctatctgcccgaatttagcgctgagagcacagagttaaaagacattgaaaaatatgggtttaatgttttgactatcaaggatttgaattatacagaaacggattataacggcagcgataaaaagatagttaaaaatccatcgtactttgttgacaagagtctttatatgcgcacttttaaaaagacggagcaggagtatgagaaaatgtttgcggagcaatttgaggcaaaaaaacggctgtcattagatttgagcgccgcaaaagtgatctgcggacatattgtaaccaatggcggcgtttctgaacactttggcctgtggcttaaacatgcgcagcgaaccattttttggatgaatgatcatacggaaaaaaagacagcaaaaaatattaaattgaaagacagcagcgaattgacgtatgatgaaagggagaaatttgcagaacatatttcaagcgatgaaaaatttaaaaaacttgatgtagaagaaaagaagagatatgtccggtggatttttgaggacagagagactcttaattttacggaggctgagaataaaaaattcggcggatatcaaaagaaaaagggagattacagattagggattttgtttgcgtcatgttttatcggcaaagaattagagagcgtgacccaaatattagactgccgtcacatcttcaaaaaacgtgaagagttttactctctcaaatcgaaagaagatattgaagcggaaattaaacgttacaatacggattatacaaatcataatatttcaaccgaacagttggatttgaagtttgttaacgtgaaaaacgcgcttgtggctaatgccgttggcgttattgacctgctctataagcagtacaaagagcgtttgggcggtgaagggcttattgctaaagaagggtttgacacaaaaaaggtagaggaggatatggaaaaattcagcggcaatatttaccgcattttagagcggaagctttatcagaagttccaaaattatgggcttgttccgccgataaagaatttgatggcggtgagggctgataaggttgaaatatcggaagcggaaaaatcaaaaataagagaaaattgcaaaataagtaaaattgatcctgaaaatgaaataataaaaagaaacaaaaccctgatattacgcttgggcagtatcgcatttgttaatgacgctgatacaagccaggagtgtccggcttgcggaacaaaaagcaaagaaaaacatgttgataactttatttgcgggtgcggatttaattctaccggcattatacattcaaatgacggtgttgccggatttaacatcgcaaaacgtggatttgttaaccttatggaacacgaactacggtaa

SEQ ID NO: 98 - DNA, 3573 bp, Unknown
  Metagenome-Derived Sequence
  misc_feature (1)..(3573): Unk30 Csm1 gene
atggagagttataagactacgaaggcggttcgtttcaggttggaggcggatgacgcggcggcgcctttggttgcgggtgaggttgcggcgttgacggcggtggggcagggttttaagataaggcgctttattaatcgcctgggggagtttttgggtgagggagttcaggaatatctgtacgacgcggaggggaaggtcaaggataatctggcggtaaagaatacatggctcaagagcaacgccaaaagggagattgccggtatgatcgccggtatgaaactccggcgcgggcttgccgtcaaggacattaaggggttgcgggagagcatagagaaagtttttaacgacgtttgggatacctacgaaaagctgttttcatccgtggacttgcccctgcacgatttggcgaagcgggcggccatagggcttctgctcaaaaggcttcaggtaaagagcgcgcttccgtatctgatttcttttgtggaggactccagcgacaaaaatgaaaccggcgacctgagtttgcgcctgaaaaggcaggcgaaagatattttggagcagttagaggccggggtttacgagtatctgccgccgcagtcgggcggcctggaggtcgccagggcgagtttcaatttctacaccataaacaagaagcctgttgatttcgggaaagaaacggaaaagttgaataacagcctgatagtgagcgcggaggagaaggttcatcgcgggattaatgtttcaaaggaggttaagtcggctattgtaaacgatattttggatcgttcaagcggcaaaaagattctgctcggcgacgcgccggagcatgacggcgaaggctgcgtgagcctgcggcagatattgaaaaacataaaaagcgagcaaaaggcggcgttcaacgaatttatgacgcagaatccgcagtttgaagcgttgaaaggcaagggctggtatcttttttcggacattacggaaaatgagtttgatgactacagaaaacagacaaaagaaattgaacgtgtggcgacgcagaaaaatcagtgtgaacgcggcgataaaaagaaacttttgcagtctgatttgcaaaaattaaaaaaacagcgcggagcgctgataaacgcggcaaataaaaagggcggtaacgagaataatttcaaaacctacaaggcgttcgctgatttttaccgcaaaattgccatggatcacgggaaaatccttgcgcggctgaaagggatagagagggagcgggtcgaatctgccacgcttaaatactgggcggtggttgccgaagttaataacaggcataagctggttttaatcccaagggaaaacgccggggcgtgcagggtatggctggacggcggcgggcataggaacggagcgtttaaaattttctggtttgagtcgtttacgttcaggagcctgcgaaagctatgcttcggctttgttgaaaacgagacgaagtcgaacacgttttacgacgagtggaagaaggaattgaccgattaccggaatgtttcgagcgaaattgacttaaacgtaacgccgggtgacagaaaaggatacacagaagaagagttgaggcagaatgagcagagaaagattaaattttacaaggctgttttggggagcggctgcgcgaagcggtcgctgaatatcccgacggaacaggtaagaaaggagattgtcaacagggaattcaaaaacctggacgaattccaaatcgccctcgaaaaaatctgctatctccgcttcgcaacgctctccgctaacgcggaggcggagttgaaaaaatacaacgcccagattttcgacattacctcgcttgacctgaaaaacccggagagcgcggcgggcaaggcggaaaaatacgaacattccgacaagcgccacacaaaaatctggaaagagttctggacggccgaaaacgagaacgccgggtttgaaatccggctgaaccccgaaatcaaaatactgtaccgccggccgaaacaaagcagggtaaacaagtacggcgagggtacggaacggtacaacccgaacaggaaaaaccgttatctgcgtccgcagtacacgctggttacaacaataagcgagcacagcaattcgcccgcaaaagaggtatcttttgtaagcgaaaaagagtatacggatttgatagatgaatttaacgggagattcaagaaagaggacataaaattcgcgttcggcatcgacaacggggaaacggagctttccacgctcggcgtttatctgccggcgttcaagaaagatacgaaagaggaaagactcgctgaactgagcaatgttgaaaaatacggatttgacgttttggctatcggtgatttaaactataaggaaaacgattgcaacggcaaagagaggaaaattgttcaaaacccgtcgtatttcctcaacaaagacctgtatatgcggacgttcaacaaaactgaggcggaatacggggagatgttcgcgcggcagttcgaggaaaaacgcctgctcacgctggatttgaccacggcaaaggtagtctgcgggcgcatagtaacgaacggcgacgttccggcgctgctcaacctgtggcttaagcatgcccaaagaaacatctttgagatgaacgaccacattaaagacaaaaccgggaaaaaaatcctgctgaaggacaaactcgatacggataacgaaaaacggaaattcgccggatatatttcgcataaggatgaattcgataaactcagcggcgaggaaaaggcgaggtacgtccaatggatttttgaagacagggattcgctcaatttcacgaagggcgaggaaaataaattcgagaggtgccaggagaagaaaggggattacaggtccggcgttcttttcgctgcctcctacaccggcgtcgatttgcagagcgtgaccgatattttcgactgccgccacgtttttaaaaggcgcggggagttttactcgattaagcctgaacgggagattaaacaggaaattgacagcttcaacactaaccggacaagccacgccatctcgaacgaagagcttgacctgagaatcgtacatgtaaagtcggcgcttgccgccaacgcggtcggggttattgatttcctctacaggcagtacagggaacgttttggtggcgaggggttgattgtgaaagaggggttcgatacaaagaaggtagaggaggacatggaaaaattcagcggtaatatctaccggattttagaaagaaggctttacagaaaattccagaactacgggcttgtcccgccgataaaaaacctgatggcggtgagggcggaggggatgagggcggatgagaaaaacagcaagcccgacctcggcgcaatagtgaggcttggaaacatcggcttcgtcaatgagacctacacgagccaagagtgccctgtctgcggcggaaatttgaaccacgaaaaggtctgcccgaaaaattgcggctttaatgacaaacggttcatgcactcaaacgacggcattgccgggttcaacatcgcaaagcgcgggtttgaaaattttctcaatgagaaacatgggggagcgcaatga

SEQ ID NO: 99 - DNA, 3585 bp, Unknown
  Metagenome-Derived Sequence
  misc_feature (1)..(3585): Unk31 Csm1 gene
atggagagttacaaaatcacaaaggctattcgttttaagttagaagccgatgaaaaagctattcccgccgttatgcgggatatttccgcgctcaggaagacgggcgacggggcggatatcaaagcttttgccgaagagttgtatgaattgctgggctatattcatgattatttgtacgacgaaaaaaatgatgatgattatatctttaagagaggattaacggtaaagaacacgtggctgagagacaacgctaaagacgagacctccggccaaacgcttaaacgcggcctcaccatcggggatattaaggggaaggactccagaggcagcgatttacaggaaaacatcgaaaaaattttcgatgaggtcgttgatatccacgaacggctggaatcggcgataaattctccgcttcaatcattgccccgacgggcgagcataggccttttactcaaaggattggccagaaaacgcgcgcttccgtatctgatctcctttctggaaggctccgatgacaaagatgagaaaagcagcgtaagcctgatcgccaaaaagcgggcaaagatcgttacggacggcttggagcgctgtatacggcattacctgccggcgcaatcgcacggactgccggtggctaaggccagctttaattattataccgttaacaaaaaagagattgactacaagggcacgatagaaaaattaaaaaaagacctgaaagtaggtagcttgaaagaggatctgaacaggatttttgataatctgaaagcgtctataagcaaggaggtaaaaacagaattattgaatgacatctcctcgcgtttaagcaacggctccgagttgtttttagggtacgccccggcggctggaatagaaaacggcaactatctccggcagattctgaaaaacataaaaagcgagcaaaaagccgcctttaacgagtttatgactcaaaacccgtcgataggcgctattaaagataaaaaactgtacctgtttagcgatatatccgaaggcgagtttaacgcctataagaagctgaccgccggcatcggtgacgcggccgctaagataaatcaggctagaaacgacggcgacaaacaacgcctgcggtcggagttgaataaacgcaagaaagagagaggcgaactgataaacgcggcgaacagaaggaacggcaacgagaataatttcaaaacgtataaagcgtttgccgaagtttaccgcaaaatagcccaaaggcacggcaaaatcctcgcccagctcaaaggaatagagagggagaggattgagtatgacatgctcaaatattgggcggtgattattgagctgggcggcaggcataaactcgttttgattcctgaaaagagagccgaagagtgtaaaaaatggttggaaacatcggacgaaagcaaccgtaaaaacggaagcgtctgctggttcgagtcatttacgctgaggagccttaaaaagctatgtttcggaaatctagacagcgggtcgaacttatttaactcaacaatcagacccctgttgcccaaagaccgaagaggcgaagccatgaacggcgatttcgccttcgcgaaaagcgcggcggaacgtatgcccgaagcgtccgagcaggatatcttgaaagaagcggaaagcgaaaagataaagttttataaaaacgtcctcaaagggcaaaaggcgcttaataacctgccggaagaggaaatccaaacagaaatagtaaaaaaagattttaacagcttagaggcgtttcagatcgcgctggaaaaaatttgctatcgcgtcttttattcgctgtcggcaaacgcggaacaagaactcaaggacaaacacggcgcccaaatctttgagattacctccctagacctcaaaaacccggagaatgtaaaagataaacaagagaaatacgcgcacgccgataagcgccatacgcgaatctggaaggatttttggacggcaggcaacgaaaaaggccgtttcgacacacgcctaaacccggagatcacgattacctaccgggaacccaagcaaagcagggtcgataaatacgggaaggggtcggcaaactacgacgccggtaagaaaaaccgctatctgcacccgcagtttacgctgacagcgaccgtctccgaacactccaactccccggcgaaaacgctctcgtttatgaccgacaaggagtttaaagagagcgttgacgatttcaacaagaaattcaaaaaagatgatataaaattcgcgttgggcatagacaacggcgagacggaactctccacgctcggagtttacctgccggcgttcggcaaaggcgccgcaaccgaagaaaagatcgccgagctgaaacaaatcgaaaaacacggctttaaggttttaaccgtaaaggacttgaattacaaagaaacggaccgcaacggcaaagagagaaagattgttcaaaacccgtcgtacttcttgagcaaagaaaattatacgcgtacgtttaaaaagtcggcggaagagtatgaaaagatgctagccggcgtgtttgaggaaaagcgcatcctcacattggacctgacgacggccaaagtgatttgcggccatatcgtaaccaacggagacgttccggcgctctacggactgtggcttaaacacgcccagaggaccgtctttgagatgaacgaccacggcaaagccaagacagccaaagacataaagataaagccgaaattggacacggataaggaaaaactgaaattcgccgagcacatctctaagattaaagagttccgcggccttaccgcggaagaaaaggcaaaatacgtcaagtggatatttgaagacaggaagcccggcgatttcacggataaagaagcggaaacgttctcggactgcctgaagaaaaaaggggactatcgctccgggatagttttcgcgtcttgctatgtgggcgaagaactgaagagcgtgacggaaatcctcaactgccggcatattttcaagaaacgcgaggagttttattcgattgactccgaagaggagattacggcgaaacttgagggctacaacaccgatagaacaagccacaatatctcaaacgaggagttggatttgaaaattacagacgccaaacgagccctagtggccaacgcggtcggcgtcgtcgattttctttacaaatactacaaacaaaacagcggcggagagggattggttgtaaaagaggcgttcgatgccaaaaaagttgaggaagacatagagaaattcagtggaaatatctataggatattggagagaaaactctaccagaaattccaaaattacggcctagtgccgcccataaagtccctgctggccgtgagaggcgaaaaagaagaactgcgcttgggcaacgtctcattcgtcaaagaagagggaacaagccagagatgccccgtttgcggggctaaaagcgatgaaaaacataccgatcggttaaaatgccaaaaatgcggatttgactcgtacggcatcatgcacagaaacgacggcatagccgggtttaacatcgcgaagcgcgggttcgagaattttatgaaagaggagcgcaaatga

SEQ ID NO: 100 - DNA, 3630 bp, Unknown
  Metagenome-Derived Seqence
  misc_feature (1)..(3630): Unk32 Csm1 gene; TGA encodes Gly
atgttagaaagttttaaagatttgtatgaggtgaggaaaacagttaggtttgaattaaagcctagtaaggtacttcctaaaataaaaattaaaaatatagatgaaaactttatcaatgaattcttttctaattataataagttattagaaatttatgaaaaagtattttttaataatagagaaattaacgggaaaataaagtttagtttctcttttctaaagacaaacttaaaaaaagaatattatgagctttgaattgacaaaataaaaaagtcagcctctgttaacaaaataaaattagaaaaaatagacaattatgagaaattaaatagttcatttttatctacattaaaaaaacaaaatgaatatgtaaattcttttaaagaaaaaatagaaagtccttatgagaataggagtagaaaatcagagttagttttattaatatataatctaaaaaagagaaataatttccctttcattgagaacgcatttaataatgtaacagcagaaaacataatggttgatgatgaaataaaaaaatgaaacatgttagccaaaactatttccaatcaattagtaactattgaagaggaactattacctcaaaattcaatgtgattagtaattgaaagagcaactttcaactattttacaattaacaaaacacctatagattatgatatagccataaaaaacaaaaaaaataaatataatgagattatatgaaagcaaaataaattaaaaaatacgtacaaaaaacaatctataaatgaatttataaaatatattatagaggatggctttagtaaatttgagaatcaaatatatgaacaaaatgggaaatatattgatacagggagaaaatgaagttcttttaacgaattaactatagaaaatgcttatacattaatgaaaaaatataaatctgaccaaaaaacagctttttatgaaataataaaaaaagagaaatataattttttaaaatcacaaaataataaaataacaattacatataacaaagatagctttaatgataaaaaagaagaaataactgtaaaactttttaatgatataagtaagtgaaattttgataaaattgcaatgttaacaaaaaagatagaaactcttgctgagcttaaaaattatttagagaaaaaagaatttaataaatttcaagaaaaaataaatactttacaagaaataataaatattaattttaataatgataatgaggaagaagtagaaaatctagtaaaaagacttaatgctgatagagttttattaaaaaaagaaagatgaacttattttgataaggaatctaacaactttgcttttacaaagtacaaagaattttgtgaagtatatcaagaagttgctatgaccttatgaaaagcaaaagcagatataaaatctttagaaaaagaaaaaattcaatctttatttttaaaatcttgggctcttatagtagaaaataaagaaaaaaatcaattccaccttttaactatacctaaaaagaacatatcaaaagcaagaaatattatattggcacttaaaaattgagagaataacaataatatattatatctttttgaatcattaacattgagagcattaaaaaaactatgtttttgaaaagaattttctgaaaatagaggagattatacagagaaaagttcaccctttagaaaaagcattgaagaaaatattactaatagtgattttgataacataaatttttatatagaaaaacaaaaaaaagatggaaacaattatagagtactaaagcaatattatgatttttacataaataaagaagaaaacaaagaattagatgaagaattgctaattaaattttataaatcagtgttacaactaccaagcacacttgagcaaataattattaaaaacttccctgactatgaaagtttcatatctaaagaatttaataacttagaagaattcgaagaaggtataaaaagaactttctatataaaacaacctcttaaaatagaagaacacaaattaaataaattaataaaagaatacaattggaatttatataagataactaattataatttaataaaaaatgatttagatgaaataaaggaattaaaagaaaaagaaaggtttaacagaaaccatataaaaaatcattctaaattatggtggaatttttgggaaaaagagaatatagacaataaataccctataagaattaaccctgaaattgctattagcttcgttaaaaaagatgataatttttatgaagaaaatcataacaaactttttaaaaacagaagatttcaagatagatttctattaacaacaagcatgacagaatttgcaacaaataagtcaatttatttaagctacaaagagttaagtgaactaaaaaatttttataattcatataattataatttttcagagaattttaagtgagaatacatttattgaatagataggtgagataatgaattagcatctctatgattatttagaaatataaacaaaaatatagaagcagtaaaaatagaaacatataaattaaaaaatgaaaatttactttttaaagagtgaacaagtaatactcctgcttataaaaatatttcaaattatattgaaaaggatgagttatttgaaataaaagaagtttcttgcatagatttaactttagcgaagttaataaagtgaaaaattgttttaaactgagacatatcaacatatattaatttaaaaattactgcagctaaaagaagtttatataatatattttctaaatgaaattataaagaatgagatataatagaaaaatgaaaatttaaagacaaaaatactggagaggaatgatatgattgaactcttaagtttaaccaaaaagaaatatataaaaataatagtgaaattgaaaaaattatatcaattgataaggtaaaaaatatactagaggaatatattgaagaaattaagcaaaatatttataatgaagacatttctattgaaaaaattaatcatttaagagattcaatatgttcaaatatgattggtataataaatttcttacaagaaaaatacagttgatatatgtttttagaaaacaaaaaaataattgactcgaacaaaaactttctaaaagattgataccaacttggaacaagatttgaacaaaaattgctacaaaaattttcaaatttaaacttagtaccttcaaattataaattatttttatcaataagagatgaagataaagaaataaagcaattatgaataattagatatatagatgagaattcaacttcttctgcttgtcctgtttgtaatcctaaattatataatgtaaacagtgatgatataaataaattatattgacattgaaaatgagaagagaaagaaaaatcaatgcatcatatcaatgataaaaatgatgaaaaccatcaagaatgaaaatgggaatcttgaaaactagaaagctgagatttatgtgatttccatatttgatataatgaaaagtatcctgattttagtttcatcaagtcttgagacgacctagcaacctacaacatcgcaaaaaaagccttggaatatttagaatacctaaaatcactaaacaacgatgaaacaaaataa

SEQ ID NO: 101 - DNA, 3774 bp, Unknown
  Metagenome-Derived Sequence
  misc_feature (1)..(3774): Unk33 Csm1 gene
atggacgcagacaagaccaccaaagccattaacgaatatcaaacacaaaaaaccattagatttgggttaactgctacaaaccaaaatctgtattctgaagaaatcatgaaattattgaatatttcagaagaaagaataataaaagaaaaagtaaaagtaaataatgataccgataaaaccaatcaattaagaggttgtttggttcaaataaaaaaatatctgaaaacttgggaaaatatttatgcacaaattgattttttggcaattacaaaagattattataaggtaatttcaaaaaaagcgaggtttgattttgacaaaggcaacggttctgaaataaaattatcttccttacaatcaactcataacaaaaagaaacgctatcagtacattatagatttttggaaagaaaatttgcgcaaaacagaaaatttatatcggaagtcagacgatttgctgaaaatatttgaggaagccaaaaatcaaaatcgtgatgacaaaaaattgaataaagtagaattgcgaaaaacttttttaaatttgtttactcttgtaaatgaaagtttgaagccattaattgaagggaatctgtttattgtaaatgacgataaaattgatgaaaaaaactcaaaacataattatgtgttctatttcatttcaaaaactgaagaaagaagactgttgtatgacaatatctgtacattgcaggattatttcaaaaataatggaggttacgtgccatttggtagggtaacattaaataaatggacggctttgcaaaaatttaataatagagatatagaaatcaatagaattattaaggaattaaagattaataatatttctacgcaaaagactgattataaatataatgactttactgaaaattttaaagaaaagaaagatgaaaatggtaaagttgttaaaaacagtgctggtaatattatctgggatttaaaagctaatgccaaatctgttatcgaaatctgccaatttttcaagtataaaaaagtaccaataaacgcccgcttaaatcttgcaaaaagattgataaaagacaacaaattaaaaaaagaacaagaaaatacgtttttaagtgagtttggtgtgttaaaaacgcctgcttttgattatgcaagagacaaagaaaactttaatctcacaaattatccgctaaaagttgcctttgattacgcctgggaaaattgcgcaaaagacaaatacgaaaagattccttttcccaaggagcaatgtgagagatacctgcaaaccgcttttgaaatagatgcgactaaagacgaaaataaaaaattgatagatacacatttgaataaatatgcagatttactacaattcaaaattttactcgaaagatttaaagcagaatttcataaaacaaacgaagaaacaaataaaaacaacattcaaaaattgagaaatgtttttagcggtttagattaccatggagacaataggttaaataaaaatcagattcaaaaagcaatcgaagcttggtttgacaacaaagagcagaacattggaaaaaagaaagaaaatgaaaaacttttaacagagaatgaaaaaaacaacttttccttatccatgcaaattatcgggcaagagagaggcggattaaaaaacggaattccaaaatacaaagaattaacggaaatgtttaaggtctgtgcttcaaaatttggaaaacaatttgccgacttgcgagattatttcaatgaagcgtatgaggttgataaaattaaataccgagcctggattattgaagatgacaaaaagaatcgttttgttttatttgtcaataaagaaaaagcgtttgacttaacttcagaagaaggtgatttatggttttacgaagtaaaaagcctgacttcaaaatcgctggtaaaattcataaaaaacagaggcgcttatccggattttcatgatgttaagaacagttttcattacagtagcataaagaaagattggcaaaactataaaaacgatccagagtttttagataaattaaaagaatgtctgaaaaattctaaaatagcaaaagaccaaaagtgggcgaagttttgttgggattttaagcaatgcgatacttacgaaaaattagaaaaagaagttgatagaaaaggatataaacttgaaggttgtaaatctgaaccaaaaacaatttcattaactcaacttacggattgggtcgaaaacaaagactgttttttgcttcctattgtaaaccaagacattaataaaggggacaaacgaactaaaaatcaaaaccagtttacaaaagattggtttgatatttttgaaaacaaaaagcgtttgcatcctgaatttaacatattctatcgcttcccaacaaaagattatccgaatacaaaatttaaaaatggaacagaaaaaacaaaacgatattctcgtttccagatgctggcttattttggttgtgaggttattccctctggcaatcatttaagcaaaaaggagcagattgcaatttttaataatgataaaaaacaaaaagaagaggtggaaaaatataacaaaagtatttcttcggattgtgactatgttataggaattgaccgaggaataaagcaacttgcaacgctttgtgttttagataaaaatggagtaattcagggcgatttccaaattttcacacggacttttaacaagcaaacaaagcaatgggaacacaaagaattagaacaacgcaatattttggatttatcaaatttacgggttgagacaacaattacaggtaaaaaagttttggtggatttaagcaaaataaaagacgatgaaggtaactataccaatctgaaacagacaattaaactcaaacaattggcttatatccgtgaattacaatatgctatgcaaacaagaccagacgatttgttagactttgtaaaaagtataaattctgctaatgatataactgcagagaatattaagcattttatttcgccatacaaagaagggaaaaattatgatgacttgccaaaagtagaaatgtttaatttgcttaaagagtgggggaatgctgatgaaaacggaaaacgaaaaatcgccgaacttgaccctgctgacaatttgaagtccgggattgttgctaatatggttggcgttgttgcatttctttgtgaaaactataactataaggtccgtattgctttggaggatttaacaagagcttatggtatccaaaaagacgcattaaatggaacagcaatttatcaaaacgatgaagattttaaggaacaggaaaatcgcagacttgccggcgtaggaacaatgcaattttttgaagttcaacttctaagaaaattatttaaaattcaagttgataaaaacttacatcttattcccgcatttcgaagcgtagataattatgaaaaaattgttcgtagagataaacagaatagtggcgatgagtttgtcaattatccgtttggaattgtttgttttgttgacccgaaatacacaagtcaacaatgtccatattgcaataatacgcataaacataagaaaaatgatacggaaacagggaaaaaagcattttatagaaataaaggagaaaacaaaaactctctattatgcgaaaaatgcggagtttcaacaattgaaggagaggaaacgctgagcagtaaaaatgataataaaaaacaatttaatattcactacattaccgacggagatcaaaatggagcgtatcatattgctaacaaggtagttataaactttcaaaaggattcataa

SEQ ID NO: 102 - DNA, 3831 bp, Unknown
  Metagenome-Derived Sequence
  misc_feature (1)..(3831): Unk34 Csm1 gene
atggaaaaaattaaaaacaaatatcaagtgtcaaaaacattgcgttttggattaacgcagaaagagaaacgccgtaaaaaaggtttcgttggagaagtgtatgaaagtcatacagaattgaaagatttgacagatttttcagtcaaaaaaatcagggcagaaatcaaacaaggcgggaactccggtattccaatagaaaaaatacgtcaatgtttgattgttattaggagatatatgaacttttgggaaaacatttattatcgatgcgaccagttgtctcttgataaagatttctacaaaaagctatcaaaaaaaatcggctttgaaggattttggcatgaggaaaataggaagacagatcacagaatcaaaaaacctcaggcaagaacaattcagttatctgaattgaacaaaaaagacgaccactataaagaacgtaaagattatatcgttgagttttgggaaagcaatataaacaaagctgccgagagatttaaggaaacggaaagtgtttttgaaaagtttgaaatagcaattaatgcgaaccgtgatgacaaccgtcccaatgaagttgagatgcgaaaaatgtttttatcacttgcaaatattatctatgaaacgcttgtgccgctatgtaacgggtcaatatctttcccgaatatagaaaagatgcagaataatgaagaaaataataacttgcgtaaatttgcggctgatgacgaatttagggcagggttgcttactcaaatagaagagttgaaagcatattttgaggaaaacggaggcaatgttcattattgcagggcaacgctaaatcccaaaaccgtaataaaaaatccaaattctaccgatagcagtatcgcagatgaagttgaaaaaacaggcattgaacgatacctgcaaaataaacaagaaattaagaacaaaatagaaaaaattaaagacaaaaatttaccactgattgagcgagcattattattcaaatataaaacggtgcctgccggcgttcagtttgacttggcgaagtttttatctgtaaaattgggtaaaaccgaacaagaattaagaacgattattcgttgtatcggacaaatacaaagccccgccgaggattatgcaaaatctgaagacaaaaaagggtttcatctggaacaatacccgttaaaatccgcgtttgatttcgcttgggaatctttagcaaaagcgatttatcataaaaatgttgatttcccgcaacagcaatgtaaagtgtttttggaaaaaaattttgacataaaaattgacagcaatgctaatttcaaactctacgcgcaacttttatatttgcgggaaaatttggcaactttggaacacagtaagccgacagatcccgacacttttgagaaaaatattagaaaattacttgacgagattaattggagcactatcgacaaagaaaaaggttcagtttataaaaacgcaatctctgattggttaaaaaacaaaaaagcaaaagatgaaaaattcggaaaagtgaaacaaagcatcggtttgtcccgcggtagattgaaaaataaaattaaaaaatttgatgatttaaccaaagactataaagatattgcaacgcagttaggcaatgcgtttgcggcaatgcgcgataaaatcaccaacgctgctgaactcaataagatttcacattacgcaactattattgaggataaaaacggcgacagatatattttgttacaaaaagtaacagagaatgaaaaacctgttggagaaaactggaataaaaacggcgaattaaaaacctatttggtaaattccgtcacatccgccgcaatcagcaaaatgattcgcaagataagaacggatgaattacgcaaaaacgaaaaaatgcaatcttcaatcactaaattaaacgaaaagcaaaaggaagaaaaaaacataaatgattggaaaaattttattgaagaaaagagatgggatttagaattcaaattagacttgaaaagcaaaaactttgagcaaatcaaaaaggaaatagacacaaaatgctatctctttaacacaggatacgccagtcaagcagatatcaaacagttagtaaaagaaaaagacgctttgttgctgcctattattaatcaggatttggcaagcaaagataaaattgtacgaaatcaattctccaaagattggcagatgatattttctgacaactcgcaaggttatcgtcttacacctgaatttagaatctcataccgacaacctacttcgaattatccgcaacctgaagagaaaagatattctcgttttcaaatgattgcacattttttgattgattatattccgcaaaataatcaatacatttcaacgcgcgaacaagtagaattgttcaaagatgaaacaaagcaaagggaagcaattgaagaatttcataaacagttaacacccaaaaccgaagctgaacaaaaagctgaaagcttgtctgcgttagctgcaaaattcaataacccaaataacaaaaaacaaaaaaataatgcatcggaaaataaacctgacgaaaaattttacgtttttggaattgacagaggccaaaatgaacttgcaacactttgcgtaattaatcaagacaaaaaaattattggtgattttgaaatttatatcagaaaatttaattcggaaaaaaagcaatgggaacatttaaaacttgaaaatcgccatattttagatttgtctaatttgagagtcgaaacgacaattgtaatagacggcaagcccgaaaagaaaagggttttggtggatttaagtgaaattaaagtcaaagacaaaaatggcgaatataaaaatccggataagatgcagacaaaaatgcggcacttggcatatatccgcaaagtacaatttcaaatacaaaataaccccgaaggagttttggattttctaaaaaaattcaaaacaaagaacgaaaccatttacaacttggttgataaggaaaatggagaaaaaggtttgatttcattttatggggccggcaacacaaatgaagatttacctaaagatgacatctggaaaatcttgcaaaaatttcaagagttaaaaaataaaacaggtgacgacaatgttaaaaaagagattaaagaattgattgaacttgagccggttgataatctaaaaaacggtgttgtagctaatatggtcggcgtgattgcttatttgttagaaaaattcgactatcaggtttatattgctctggaagatttgacaaaaccgttcaacgaagatattaaagacggcacaactggggtgaaaggcaattacaaaggcgaagggaaacgggctgatgttgaaaaatatgccgggctcggactgtataacttctttgaaatgcagctacttaaaaagttatttcgtattcaacaggaaaatgataatgttttgcatttagtacctgcgtttcgtgcggtaaaaaattatgaaaatttgatcgcaggtaaaggtaaaattaaaaaccaatttggaattgtttattttgttgatgcaaactcaacgtcaaaaacttgtcctgtctgtagttctatacctgataagaataattcgaataacaaaaatgcaaaagggaaaaaaataataaataagaaaggaaacgaaagtgttatttgggttgagcgagataaatctaatggcaacgacattatccgttgttatgcctgtggttttgatacaacaaaaaattattccgaaaatccgctaaaatacattaaaagcggtgatgacaatgctgcatttattatttcaactttaggaattaaggcgtatgaattagcaaaaactttggtggcgaataaataa

SEQ ID NO: 103 - DNA, 3831 bp, Unknown
  Metagenome-Derived Sequence
  misc_feature (1)..(3831): Unk35 Csm1 gene
atgaaaagttttgaaaacagctgtcaaataagtaagactttgcgttttggagccacattaaaagaggataaaaaaaaatgtaaatcccatgaagagcttcaagagtttgttgacatatcatataaaactatgaaaagtagcgcaacaatagctgaaagcctaaatgaaatagagttagtcaaaaaatgtgagcgatgttatagcgagattataaaatttcatgaagcttgggggcaaatctattgtcgaacagaccaaattgcagtatacaaagatttttatcgtcaactggcaagaaaagctagatttgatgtaggcgatcaaaatagtcagctgattaccctctcatcattgagcagtaagcataatgtgtatcaaggactaaaaagatcgcaacatattacaaattattggaaagataatattgctcgtcagaagagttttttaaaagattttagccaacagctccatcagtacaaaagagctcttgaaaatagcgataaagcgcatacaaaaccaaatcttatcaattttaataaaacattttcgatacttgcaaatcttgtaaatgaaatcgtgattccactgtctaatggtgcgatttcatttcctaatatcagtaaacttgaggatggagaggagagccgccatctaatagagtttgcactgaatgattacagcgatttggtcggctcgataggtgagttaaaggatgctattgctacaaatggagggtacacaccgtttgcgaaggtcacactcaaccactataccgcagagcaaaaaccgcatgttttcaaaaatgatattgatgccaaaattagagaattaaaacttatagagttggtagaaaaattaaaaaataaaacttctaaacaaattgaggagtatttttctaagtttgacaagttcaagatctatgatgatagaaaccaatcagtcataattagaacgcaatgttttaaatacaaaccgataccttttttggtcaaacacgaattagcaaagtatattgcggaggatgaagacgctgtattaaaggtgttggatgccattggtgcgacaagaagtcctgcgcatgattatgcacacaatgaagatgtatttgatttaaaacattacccaataaaagtcgcttttgattatgcttgggaacagttggcaaacggtgtttatactacggtctcttttccagaagagaagtgtagagagtatcttaacgctatctacgggtgtgaagtcactaaagaacctgtttttaaattttatgcggatttgctttatattagaaaaaatttagccgtccttgaacataaaaacaatttgccgagtaatccagaagagtttatttgcaagattgaaaatacatttgaaaagatagtattgccatataagattaaggaatttgagacatataaaaaggctattttaacatggattaatgacggtcgtggtcatgaaaaatatactgattccaaaagagagcttggtctaatacggggtggattgaaaggtcgaattggggctcaaaaaatgtttcgtaaaaacaaaaagggagaattaataccttactacgaaaatccatatacaaaattaaccaatgaatttaaaaatatatcttcaagttatggcaagacgtttgcagagttgcgagataagtttaaagaaaaaagtgagataacaaaaattacccattttgggattatcatagaggataacaataaagataggtatcttctagccaatggattgcaacacgataatactgatcaaagcaacactcaagtagaagcgatactgggcaaactcaatacctctttagaatttaccacctatcaagtgaaatctttaacctccaaaatattgattaaacttatcaaaaatcataccacttcacctaatgccaaatccccgtatgcagattttcatacttcaaagatacatgttgactggactaagattaaaaaagagtgggatacttataagagcaatcattcattattgcaatatgttaaagattgtcttaccaactccacaatggcaaaaaaccaaaactgggcagagtttggatgggatttagagagctgcaacagttatgaagcaattgaacatgagattgatcaaaaatcatacatattgcaaaaacacacaatatcaaaggcatcaataaagtctcttgtggagaatgggtgtttattgttgcctattgtcaatcaagatattacctcgcaagggcgaaaagataaaaaccagtttagtaaagattggaaacaaatttttgaagactcaaaagagtacaggcttcatccggagtttgcggtctcttataggacacctataaaggattatccaaaagataaacgatacggcagattacagtttatctgtgcctttaactgcgagattatccctcaaaatggggaatttatcaatctcaaaaaacagatagagaattttaatgatgaagatattcaaaagaacaatgttgctgagtttaacaataaagtaaacgaagctttattgggcaaagagtatgtagttatagggatagataggggcttaaagcagcttgccacactgtgcgtccttaataaaagagggaaaattttaggcgactttgagatttacaaaaaagagtttgtccgtacagaaaacagaagtaagaattattggaagcataccctagcggagacaaggcatatccttgatctatctaacttgcgtgttgaaactacagttgaggacaataaggtactggtcgatcaaagccttacgcttgtgaaaaaaaatagagatacccctgatgaaaaagcgacagaagagaacagacaaaaaatcaaactcaaacagttgtcatatataagaaagctccaatatgcgatgcaaactaacgagcaagctgttttggatttactaaaagataactccgatgatgaagagttcaaaaagagagttgagggtgttatctctccttttggagaggggcaagagtatgcggatttgccgattgataccatgagagcgatgatacaagatttacaaggtgttatagcaaaaggcaataaacaaacagaaaaaaacaaaatcatcgagcttgacgctgccgatagtctaaaacagggcgttgtagccaatatgattggcgtagtgaattttattttagcaaaattcaattatgaagcctatgtgtcgttagaagatttaagcagggcatataacgtggcaaaaagtgggtatgatggacggtatctgccatcgactagccaagatcctgatatggactttaaagagcaacaaaaccagatgttagcagggttgggaacctatcagttttttgagatacaactgctaaaaaaattacagaaaatacagagtaataatactgttttgcgttttgttcctgcctttagaagtgccgacaattatagaaatattattaaattaaatccaaaatatgataacacagaatatgtgcataaaccgtttggtattgttcattttattgatccaaaagatacttcaagcaaatgccccgtatgtggcaaaacaggtaaaaaaaatgtagatcgaaatgaaaaaaagaataatatcttgctatgtaaagcgtgtggatttagaacagtttgggagcttaaacagccagaaaatatcaagagtgagggatattgttttagcgaagatgagattcaaaagacgataaaaaacaatcaaaagcaaatggagataaaaaagctttcagataaaaatattcactatatccacaatggagatgacaacggagcatatcatatcgctttaaagagtgtagaaaacttaaagcataaggaataa

SEQ ID NO: 104 - DNA, 3894 bp, Unknown
  Metagenome-Derived Sequence
  misc_feature (1)..(3894): Unk36 Csm1 gene
atgaaaagcattgtaaataactatcagatttcaaaaactttgcgttttggattaacgcaaaaaacgaaaattcagaaggaagggtataatggagagatatatgtaagtcacagagagctctgtgatttggttaaaatttcagaagaaagaattaaaaaaagtgtttcagctagtgataagtcaaatcttgagttatcaatagatataattgatacatgtcttaaacaaattggagttttcctatcggattggcagcaagtatattatagaaaagatcaagttgcattggacaaggattattataaaattctttgtaaaaagatagagtttgatggtttttggaaagatgacagaggtcaaagaatgcctaattcaaggataataaatatatctgaattagataaaagggatagcttgggtgttgagaggttgcattatatattgaattattggaaagacaatttggtcagcgcatctcaaaaatattcggcagtagaggagaaaataaaacgatttaagtcggctataaaaataaataggacagataacaaaccagacgaagttgaacttagaaaaatgtttttatctctggcaaatattgtttgtgatacgcttcaacccttgtgttatggccaaattagtttcccaaaaataaataagttggacgattctagaactgataacaaaaagctaataaaatttgcaacggaatataagtctaaaaatgacttgctcactagcattgcagagcaaaagaaatattttgaggaaaatggcggcaatgtcccattttgccgagccaccctaaatcctaagacagccataaaagaccctaattcaacagataacagcattaaaggtgaaatagctcagttaggcctagattctatattgaagagttttaaatcttatttattctttgaaaacagtttggagaatatgtcagcaaaagaaaaaattgatttaatgaagagcgatggagctagtatcattaaaaaagggcttatgtttaagtacaaaccaattcctgtcatagtacacagagaagttgctcaggaattaagtgaagatttaaataaaactgaggaatcattaagtgattttttgcgaggtattggacaagctaaaagtcctgcaaaggattatgaagagttgactgataaaaatgaatttaatatagaggcatacccaataaaggttgcatttgattttgcttgggaaagtttagcaaaggctaaatatcacagtgaaatagatttgcctgtagattcttgtaagaagttcctgaagacttttgatgtgacaccggatgacgctaattttctattatatgctcaacttcaagaactcaatgctcttatatctacgttagagtatggatatccttctgatgaacaatccattgtaaaaaaaatcaaggctctgtctaatgaaatacaatgggagaaagtttctgacaggaacgggcaagaatacaaaagatcaatctctgattgggctgatggcaaaagagattctgacggttttaaaattgcaaaacaaaacataggtctttttagagggggattaaggaataaaatagataagtattacagtttaacgcaaatatataaaaagactgtgatggatgagggaaagatatttgctatcatgcgagataagataataggtgcagccgaacagaataaagttacttattatgcggcgattatagaggataacacaggagataaatatgtgttattacaggagttgccattgaacggacaagacagaatttatgacaaaatgacccgagacggagatggatacgtttgctgttttgtcaattccattacatcacgcactattgctaaacaattaaggaagaagagaatggcggagctaaagaagaataaagcgtggggggcatataatgataatgttagtaatactcaacagccggtactttctgatgaagaaaaagaagaaagaaatataagggaatggaaaagttttataagtgagaagagatgggattgtgagtttaatttgaactttaaaggaaaaaactttgaggaaatcaagaaagaaatagatgcaaaaggatatgaattagaaaacaggcgcttgagcagagaagcgcttgatgagttagtaaaaaacaataaatgcttattgttgccaatcgttaatcaggatattataaaagagaacaaaacggagagtaatcaatttaccaaagattggaattctatttttgacgataattctccgtggcgtctaacccctgaatttagagtatcttaccgcaaacctactcccgattatcctgtatctagtaagggagacaagcgttactcgcgtttccaaatgattgcccattttttatgcgattacattcctaatagtgatagttatgtatcagttagggaacaaattgagaattataaagatgataaaaagcaagagactgctgttaaggatttccataataggttattgggaaaaactgaggagcaaaaaataatagatagattgggtgcatttcagggttggggtaatgttatcataaaaaagactaaaccagaaaagcaagaaggttctaaagaaaaattttttgtttttggaattgacagggggcaaaatgaacttgctaccctttgtgttatagaccaagataaaaaaattcaaggaggctttaaaatatatactcgttcattcaatagcgagaaaaaacaatgggaacataaattcctggaagagcgcaatatcttggatttgtcaaatttacgtgtagaaactactattgttattgatgggcaggaaaaaaaggagaaagtgttagtggatttaagtgaggtaaaagtaaaagaccattttggaaattatgtaaaacctaataagatgcaagttaaacttcaacggttggcatatatccgcaaacttcaattccaaatgcagacgaatcctgaaagagttctagaatggtattctcataatcagactaatgatttgattattaacaattttgtagataagcaaaacggggagaaaggacttgttccattttttggagctgctgttgcagaattaaaagacacattacctatcgataggatttccgagatgttaaaacagtttgtggaactaaagaatttggagaagcaaggggaggaggtgaagtcaaaaattgaccaacttattgaacttgaaccggctgataatctaaagtctggtgtggttgcaaatatggttggtgtaattgcatttcttcttgaaaagtacagctatcaggtctatatttcattagaagatttgtcaaagccatttgaaaaccaaattgttttgggaatcagtggggtaccaattggtattaacaaaggcatggctggtagaagtgttaatgtcgaaaaatttgcaggtcttgggctttataatttttttgaaatacaattgttaaagaaattattccggatacagcgggatagttgtcatatcttgcaccttgtacctgcttttagggccatgaaaaattatgataatgtggcagtaggaaaagggaaaattaagaatcaatttggaattgtattctttgtggacgctgctgcaacatcaaagacatgtccttgttgtggcgctaacaatagtaaaaagtttgaacctgattttagaaaattccctaatgctaaaaaatttgagactccagataaaaagtctgtttggttggaaagagataaatctgatggtaaggatattataaggtgccatgtatgtggatttgatacttcaaaagagtacgatgataatccacgtaaatacataaaaagtggggatgataatgcagcttatttgatctctgctgagggtgttaaggcatatgaactagctacaacgttagttgataataaataa

SEQ ID NO: 105 - DNA, 3948 bp, Unknown
  Metagenome-Derived Sequence
  misc_feature (1)..(3948): Unk37 Csm1 gene; TGA encodes Gly
atgattaatttagaaaattttaaaaatttgtatgaagtgaggaagacagtgaggttctgattaaatcagcctaacaaaaaatgagattttaaaactcatttagaatttaaagattttactgaaaagtcttttcagaatgtcgaaaatgagctagcatcaaatggtaagtataatatcggtgatgaagaacagcttattaaaaaaatatctgcttttgttgaacaactaaaaattcaactatgatactggaaagttttttatcaaagatatgatttaatagctataaataaagactactataaaatattggcaagaaaggcaaaatttgatgctatctgggagattagtaaatcaaataaatatataaaagttaaacaacctcaagcaagtcaaatttctttatcatcattaaagatttgaaataggagtgatagtattattcaatattggtgagagataattgagaaaacagattatttactcaatatttttaaacctaaattagaacaatacgagagggctattaaagatgctaataatgctcatattaaacctgatagtattaactttagaaaaacctttttacaacttttgaaactaactaaggaatttttacaacctttatctgacagatcaattatttttgagttttcaaagaagaaagtttctaaagaaattgaaaagatttctgagtttgcttgagaaaaaaataatacaaaaatttataatgtattgaaaaattgagaagaacttagacaatattttgaagcgaattgatcccaagtttcatattgaagagtaagtctaaactattatacggcggtacaaaaaccaaataattttgatcaagaaattaaaaaatctatagacgatttatgaataataaattttttgaagaaaagtgatagtcaaattatcgattatcttcatcaaggatcaaaacagaaaataaaattgttacttacttcaaaacatccttatcctattgagttattacagttatttaaagtaaagcctattcctttttcagtaaaatataatttggcaaaatttgtagagaaaaattataaaagtgaaaccaatttatcttatgaagacattctaaataaatttaatttattatgaagagctattgatatcgcgaatgattttaaaaattctaatcataaaggcaatttttcccttgatgaatatcctgtaaagttagcctttgattatgcttgggaaaatacagcaagaagtttaaaaagggatatttctttcccaaagaaagtgtgtgagagatttttaaaagataattttgatattgatgttgataatgcagattttaaattatacgccaatcttttattcatagcggataatctagcaactattgaatataataatccaaataatgaagcagaacttataaatgaaataaaacaggcatttgaatgcatgagcttttcttttgaaaaaaaagtatatgaatgacataaaaaagctatcttggaattattagataaggaaaaatcccaaagagactattctactatatcaaaagcaaaacaagaattgtgattattaagatgatgactgaaaaataagattaaaaaatacagagatttaacacagagattaatagacaaaaagaattcacatttttgaattgctagttttataggaaaaacacttgctacaataagagatggactgaaagaagaaaatgaattaaataaaattagtcattatggagtgattattgaagataataatcaagataaatatattcttatatcaaaacttgaaggaaaagacagaagagataagattgttcaaaagctttgaaagtgagacataaaggtgtatcaagtaaattcttttacttcaaaagcattaaataaatttatcaaaaatcctttgtcagaagacgcaaaaaaatttcatgggaaatataaagatgaatatggtttttgatatgaaaataaaaattgagatttcacttataaagtaaaaaacgtttcagaatatgacgaacaaggaaaatggatatgatatcaggaagaatttttaaatcatataaaaaagtgtttaattgattctgagatctcaagagagcaaaattggacggcctttggttggagttttgatggttgtaataattatgaagagatagaaaaagaaattgattctaaatgatatcagttgaccgaaaattctatttcaaaggggaatttagaaagcctcgtgaaagatgaagattgttcgttgttccctatcattaatcaagatatttcaagtcaaaaacaagaaaataaaaatatttttactttagattttgaaaaagtatttgagagaaaagaatgtaggattcatccagaattttctatcttttatagaaagccaatagaagaacacaagaaggagaataaatcatgaatcataaatcgttttggaaggttacaattattagcaaatcttggtatagaatttgttccaagaaatctttcttttaaaacaaagaaggaacaaaatagaattgcgattgatcaaaagaaacagaatcagttagtgcaagagtttaatcaagaaaaagtaaatacgtatttcgaaggattagataattattatatttttggaatagatagatgaataaaacaattagcaactctatgtgttactgataaaggttgagttattcaggattttaccatctttacaaagcattttaaccaagcctctaaaatatgggaatatagagaaaatagaaaggaatgaattcttgatttgacaaatcttaaaattgaatctgataaaaattgaaatacttatatagttgatatttcattatttgatgcaaaggatgataattgaagatctacaggaacaaataaacaaaatattcaattaaaacaacttgcatatattagaaaattacaatatcaaatgtctgcaaatgaaaaatgagttttggatttcatagcaaaatatataagtaaggatgaaagagaacaaaatataaaagaactcattactccatataaagaatgaaaaaaatttgcagatttgccaatggatatttttcaagaaatgtttgaaaattattatagattaaaaactgatcaaaatttgtctgaatttgagaagaaaaatctcatgaagatcactacagaacttgatgcgagtgaaaacttgaaaaaatgagtagttgcaaatatgatcggagtgatttattatttgatgaaatattatgattataaggtaaaaattacccttgaaaatttaaatcaatctttttgatgacaggttgattgaataaataatcattatgtagatataaagaataatttcatgtaccaagaaaatcaagctttggcttgagtctgaacatatcatttctttgaaatgcaattattaaaaaaaatatttaaaatttctactgaagaatgaattttacatttggttccaagttttggaagtgtgaaaaattactttaaagatattgaaaaatactcattgattgtcaatatttgaagaaatgaaaaatataaccaattttgagttgttcactttgtaaaacctgataatacaagtaaaaaatgtcctgtttgtttaaatacgcaaacgacttgaaaaaaagaatgaatgccgatcataaatagaaattacaaaaaatctaatatattttattgtgaaagatgctgattccaatcaatacacagtcattgtcaagaagaaaatattaaagatagtaatgattttcattattctgtagaagaagtagaaagaatagagatgaaaaataaagaagcaatagaaaaatataaaaaacaatgaaaaaatcttcattttataaaaaatggagatgataatgctgcatataatatttgagagaaaataagagaacttccaaaaaaatcagatgtaaagaatacctcgatttcatgaaatatttctttttcatag

SEQ ID NO: 106 - DNA, 3831 bp, Unknown
  Metagenome-Derived Sequence
  misc_feature (1)..(3831): Unk38 Csm1 gene
atgaaaagttttgaaaacagctgtcaaataagtaagactttgcgttttggagccacattaaaagaggataaaaaaaaatgtaaatcccatgaagagcttcaagagtttgttgacatatcatataaaactatgaaaagtagcgcaacaatagctgaaagcctaaatgaaatagagttagtcaaaaaatgtgagcgatgttatagcgagattataaaatttcatgaagcttgggggcaaatctattgtcgaacagaccaaattgcagtatacaaagatttttatcgtcaactggcaagaaaagctagatttgatgtaggcgatcaaaatagtcagctgattaccctctcatcattgagcagtaagcataatgtgtatcaaggactaaaaagatcgcaacatattacaaattattggaaagataatattgctcgtcagaagagttttttaaaagattttagccaacagctccatcagtacaaaagagctcttgaaaatagcgataaagcgcatacaaaaccaaatcttatcaattttaataaaacattttcgatacttgcaaatcttgtaaatgaaatcgtgattccactgtctaatggtgcgatttcatttcctaatatcagtaaacttgaggatggagaggagagccgccatctaatagagtttgcactgaatgattacagcgatttggtcggctcgataggtgagttaaaggatgctattgctacaaatggagggtacacaccgtttgcgaaggtcacactcaaccactataccgcagagcaaaaaccgcatgttttcaaaaatgatattgatgccaaaattagagaattaaaacttatagagttggtagaaaaattaaaaaataaaacttctaaacaaattgaggagtatttttctaagtttgacaagttcaagatctatgatgatagaaaccaatcagtcataattagaacgcaatgttttaaatacaaaccgataccttttttggtcaaacacgaattagcaaagtatattgcggaggatgaagacgctgtattaaaggtgttggatgccattggtgcgacaagaagtcctgcgcatgattatgcacacaatgaagatgtatttgatttaaaacattacccaataaaagtcgcttttgattatgcttgggaacagttggcaaacggtgtttatactacggtctcttttccagaagagaagtgtagagagtatcttaacgctatctacgggtgtgaagtcactaaagaacctgtttttaaattttatgcggatttgctttatattagaaaaaatttagccgtccttgaacataaaaacaatttgccgagtaatccagaagagtttatttgcaagattgaaaatacatttgaaaagatagtattgccatataagattaaggaatttgagacatataaaaaggctattttaacatggattaatgacggtcgtggtcatgaaaaatatactgattccaaaagagagcttggtctaatacggggtggattgaaaggtcgaattggggctcaaaaaatgtttcgtaaaaacaaaaagggagaattaataccttactacgaaaatccatatacaaaattaaccaatgaatttaaaaatatatcttcaagttatggcaagacgtttgcagagttgcgagataagtttaaagaaaaaagtgagataacaaaaattacccattttgggattatcatagaggataacaataaagataggtatcttctagccaatggattgcaacacgataatactgatcaaagcaacactcaagtagaagcgatactgggcaaactcaatacctctttagaatttaccacctatcaagtgaaatctttaacctccaaaatattgattaaacttatcaaaaatcataccacttcacctaatgccaaatccccgtatgcagattttcatacttcaaagatacatgttgactggactaagattaaaaaagagtgggatacttataagagcaatcattcattattgcaatatgttaaagattgtcttaccaactccacaatggcaaaaaaccaaaactgggcagagtttggatgggatttagagagctgcaacagttatgaagcaattgaacatgagattgatcaaaaatcatacatattgcaaaaacacacaatatcaaaggcatcaataaagtctcttgtggagaatgggtgtttattgttgcctattgtcaatcaagatattacctcgcaagggcgaaaagataaaaaccagtttagtaaagattggaaacaaatttttgaagactcaaaagagtacaggcttcatccggagtttgcggtctcttataggacacctataaaggattatccaaaagataaacgatacggcagattacagtttatctgtgcctttaactgcgagattatccctcaaaatggggaatttatcaatctcaaaaaacagatagagaattttaatgatgaagatattcaaaagaacaatgttgctgagtttaacaataaagtaaacgaagctttattgggcaaagagtatgtagttatagggatagataggggcttaaagcagcttgccacactgtgcgtccttaataaaagagggaaaattttaggcgactttgagatttacaaaaaagagtttgtccgtacagaaaacagaagtaagaattattggaagcataccctagcggagacaaggcatatccttgatctatctaacttgcgtgttgaaactacagttgaggacaataaggtactggtcgatcaaagccttacgcttgtgaaaaaaaatagagatacccctgatgaaaaagcgacagaagagaacagacaaaaaatcaaactcaaacagttgtcatatataagaaagctccaatatgcgatgcaaactaacgagcaagctgttttggatttactaaaagataactccgatgatgaagagttcaaaaagagagttgagggtgttatctctccttttggagaggggcaagagtatgcggatttgccgattgataccatgagagcgatgatacaagatttacaaggtgttatagcaaaaggcaataaacaaacagaaaaaaacaaaatcatcgagcttgacgctgccgatagtctaaaacagggcgttgtagccaatatgattggcgtagtgaattttattttagcaaaattcaattatgaagcctatgtgtcgttagaagatttaagcagggcatataacgtggcaaaaagtgggtatgatggacggtatctgccatcgactagccaagatcctgatatggactttaaagagcaacaaaaccagatgttagcagggttgggaacctatcagttttttgagatacaactgctaaaaaaattacagaaaatacagagtaataatactgttttgcgttttgttcctgcctttagaagtgccgacaattatagaaatattattaaattaaatccaaaatatgataacacagaatatgtgcataaaccgtttggtattgttcattttattgatccaaaagatacttcaagcaaatgccccgtatgtggcaaaacaggtaaaaaaaatgtagatcgaaatgaaaaaaagaataatatcttgctatgtaaagcgtgtgcctttagaacagtttgggagtttaaacagccagaaaatatcaagaatgagaaacactgttttagtgaagatgggattaaaaagacggcagaagacaataacaaaaaaataaaagaaaaaaatctttcagataaaaatcttcactatatccataatggagatgacaacggagcgtatcatattgctttaaaaagtgtagaaaacttaaagcataagaaataa

SEQ ID NO: 107 - DNA, 3516 bp, Unknown
  Metagenome-Derived Sequence
  misc_feature (1)..(3516): Unk39 Csm1 gene
atgaataatataaagacaacaaaagcaataagatttaaactcgaaaactctgctagtaatagagaaatacaagaacgtatagacaatctaagttcaaataatggtttcgaccttgtatcttttgtaactgaattaaataactatattgatttattgaatggttatttgttttgttcaaggggtgataggttttacctaaacgacaagtttattctaaaaaaagaatggatgaaaaactatgctaagcaagagtttgcagagtttaaaaccaaaatcgacaatacagctaacggtgtaagagtacaatatacagttggcgattatagagtagaatcgaaaatacaagctgcattcgataatatagatgaaatatatggtgaactttgcgatgatgcttcgagggaacttaatgaaagatctaaacgcacacgaacagcgttgctattgaaacgcttgtatgcaaaaaataatttgccattgcttattgattttgtggaaaattcgacatataaaaaggaagtaggtaatgatagtttggtgttgaagtcgatgggaaaacgattgatggagcatcttgaattgggtattcaggagtatttgcccgaacaatcggccggtgtgtctattgccaaagccagctttaactactatacaataaataaaaagcctattgattatgatgccaagatagaggaaatagaaaaaaaattagttgttagtaatatcgaccgaacttggaatgatagggataataagataaaaaataatggtagattatggaatattgttaaggctgatattgcaagccgacaaaataataaaccgttgtgcatcggcgactctccttttatggatgttgatgaatatgcaagtttgcgacaaataatgaagaatatattgtcggaacaaaaggcggcttttaatgaacttatgcaacaaggtggtagttacaaagaattgcaaaatactgatttgtatttgtttaaggatattacaaaggatgagtttgataagtatagcgaacttacagaagatatagaagaattagcaacaaagcggaatcaaactaagaacgagcaaaagaagaaagaactgaagtcgcagattgaaagattgtcgaaacaacgtggaagttttataagcgaagcagataaaactacagaaaagatgtttaaaacttataaggctttttcggtattatacaaaaaaatagctcaaaagcatggtaaagaattggctaaactgaaaggtatagagaaagagaaagcagaatcgcaaacattgcaatattgggctatgattcttgaaaaagataatagacacaaactggtgttggtaccaaaagcgaaggcaaacgaatgccgaagccgattggtagaggctgataatgccaatggagtcataaaattatattggtttgaaagttttacttatcgcagtttgcaaaaactatgttttggaaatatcgaaaatggaagtaatacgttctatccgcaaataagaagggatagggagcttggtcgtaaatactctagtcttgataggaatggttatcctaaatttatatccggagaacatgagtttgcaggtgacgaacagcgtaaaatacaattttaccaagatgttttgagaacagactatgcaagaaagaatctgaatttgccatacggtaaggtggaagaaaggattataaattcaactttcgaatcgcttgatgattttaagatagcattggaaagtatttgttaccgtagagctgtatgtaccaatattcatttgatagatgctttggaaagtgagtatggtgctcagatttttgatattacgtcgttggatttgcgaagagaggataatataaaagataaagaagagaagtattcgtattcctacaaatctcacactgctgtatggaaagaattttggactgcggagaacgagaagcgtaattttgatatacgactgaaccccgaaataagcataatataccgcaaagccaaggaaagcagaatagaaaaatatggtgtcgacagcaaaaagaataatagatatttgcatgatcagttgacgttggtaactacattgtcggaacattgcaattcgcccgaaaggaatattgcttttgcaactatcgacgaggaagagagaataatagctgaattcaacagtaagttggataagggaaatattcgttttgcttttggtatagacaatggcgaagtggaactttctactttaggagtatatttgccggagtttaagcagaaaagtattgaaagttcgctcacggaggtgaataatgtagataagtatggttttgacacattgactatccgtaacttgatgcattccgaaaaagatgtgaatggtagagatagacgaattattgataatccctcttattttttgaaagaagatttgtattgtcgcactttcggaaagaatggcgaagaatacaaggctatgtttgacaaagtgtttgaacaacggcggttgttgacgttggatttgagcacagccaaagtgatatgtggtaggatagtaacaaatggcgatgtgatttcgctatacaacctatggatgcgacatgctcaacgcaatatatacgatatgaacgaacatatagaaggtggcggagcaaaagtgtatttgaaaaagagcgaggtactaaacgacaatgaaaaacgtaagtttcttgactacttgaatgatggaaatgaaagatatgaaagattatcggatgcagagaaaaaagattatataaattggatttataagatatgggatggagtggaagttgaaaatgatagatttgcagaagtaaggaggaaacaaaagagaccgggcttctactttcacaatgtgctattggcagcaagctatataggcgaagaagttcaagatgtgaaagatatagccaatatagacgatgtaagacatgtatttaaattccgcgaagatttcaaacaatttaagcaggaaaaagaaatacttgacgagattaataaatacaatatcaaggtaatttcgaacgaagaattggatttgaggctcaatcagttgaaatcgtcgttggtagccaatgtgataggtgtgatagactatctgtataagcaatataaggaacgttttggtggcgaaggtattattgccaaagaaggttttggtatagaaaaggtagaaagtgatagaatgaagttttcgggaaatatatatcgtatgcttgaacgtaaactatatcagaaattccaaaactatggaatggtgccacctatcaagaatttgacagcatttagaagtaaagataaatcatacactcaaataggatatatatgttttatcgattacgacgggacaagtcaaagatgtccaatatgcaatgccaagttggcatataaccatggcttggaatgttcggaaaaatgtggctttgatagcgaaggtataatgcattccaatgatggaatagcgggctacaatatagccaaaaaaggatttgaaagcatagttaataaataa

SEQ ID NO: 108 - DNA, 3498 bp, Unknown
  Metagenome-Derived Sequence
  misc_feature (1)..(3498): Unk40 Csm1 gene
atgaatgattggcaaaatttgtatgcggtgaggaagactattaactttgagtttaagccatcattgtatacaaaaaaaagagttttagatgcgagaataaaacgaaattctgttcttattgatgtaaaaaacaatactattgaaataattcatctttttaatactcagaatcaagaagtggcaaatttggtgcagagatatttacaaaaattgacatctgattttgatattcttgttgaaaaatttaaaaatattacagatggaatttatataaatggaagatatgagaattttaggatctatgttgaaacaagtaagttgaagttagttgggaaggattttagagattgctattttcaaatgaagaatgaaaggggaaaaagtcggaaaggctgggattattactatcaatttaatgcaaaaactaataaggcagaatttcggcatgtaaaatttggtgattttttaacagtaagtcacctatttgcatttcattatgataaaacgacaaaagacggtgaatttcaaagacttttgaaagaaaaaataaatttctttataaaaaaatataaatgtattcaaattgaacttagtgattttcttgatgataataatcgattcgaaaaatttatttcaaagcctgaaattttagatcgattaaagcgtcttgcatattgtatcggggatatcctttctttaatgaatatcttttgtgataaagggaaaaatggatctgatggttgttctgtctttattaaggatttaggggattttagaataatagctttggataatgattatgaaagcgttgtcgctgagattattaggcaggtaaattgtattaccaaccctaaagccttccattttaagtttaccttaaactttaaggcaaaaaatccgaatactcagctttctggtaatgatgttttttttaatgagaaagatttacaaaaaaaattaaaggaagaaatggataagttagagaataataagaaagaaaaatctgaatgtcagagttttctttcaaaatttgataatctagctggtaaggattgtacggatggtaggtgggcggatataaaaaataaacagggtcttcctgataattaccaagatgcaaaaaaagaatacgaaagttgtgagggtaagaaaaaggaattgagcaaggaaattgcatataatgaaaatgagaaaaataattacgctgttataaatcaacttaaagctgccattagtaatagtaaaaatacacattttggtgttgttatagaaaaagaagcaaactattatttggccttggaaaataaaatttcgaatggaaagctaaaagcagataataaatatgttcttaataatctaaaaaataaccttttttcctgtaaacttttaaaatatgaatccttgacatggaaagcggttgaaaagctttgtcttttgcccacttcgtcacttaatggtacaagcaaggatgttgttggttattggagtaagttttgtaagggtgtgataattctggagaaaaaaaatgaaaaagataaaagagacgtttttgatctgggaataataaaaaactacttggttgaaataatgtcaaaaacaaatatatcttcgggctttaataaggaagattttgataaattggtaacccttgatgggataaaagcctattttgacgattattgttttgagaatcaatggattgatgcagattgggatgaatttttaggattagatagagaaggaagtattgatttatatcagattttcaataaagattttgaacttgatgaacattttgctatttctgagaatgataaagaaagaataaaaaggattaagtttgcccaattaatattgaaagaaagattcgtagccaagcaaaaaaatagtgaaaggattagaaatctatttaccatatattggcagaattgcttcaataaatttgatactgagaaatttagagtacagcctgaagggcggatatatattcgagatatgagtcctgtaaatgatgcgaagagataccgagaagaaaaagttttgggggattttggaatactttttaatccagtggcaaaagcaatcgatcaatcgtcaaaagatgtgaaggataggattggaaattttaatgactatctaaaaaaacagcctctcaaaaatgaaatatatgttgttggtcttgatagaggtgaaaacagtcttgtgagttatacgcttgtgaagtttagaaaaaaaattgtaggcgaaaatgatattagtgttaggtttgacagcttaattggcacagaagcgtgggttttagatgaaatggtggaagtaagggatttgtcggctgtaaaaatttttaatgagaaaggaaaatggagaaaaagtgaatttgttgaacagaaagaggattattattttgtagaaaaaaatgagggaaattatgatgaagataaaaataaacaggatgcctgtaaaaaaagagatgaattaaaaaaaatgtatcctgattatggcgatggtagggaaagggttgttgtctgtccgataaggtgtaaaccacaaacgaaaaaagagaagcaacaggtcgaaatggaaaaaactggtgcatatgctgtgaaaattttgtcttgggaagatgaagatggagctgtttataattatcgagtagctcaggaaattcttaaggaggagagattgagtcaagttgaaaaaaatagagattttgaattgtttaatactgaaaaatttaaaaatggatatgtgtcagctttgattggatttattggtgaaagggtggaaacaaataatgcttatgtttctttagaaaatcttaatatgggagataaaacgggaaagggaggaaactataggaaaacatttggtgcaagtgtatatcaaatgattgagaatcgattgatgtcaaaacttggatattctgtagtgaaaggttcctcaagtgttcattcccaaaaagtcccaaaaataagaaaggttgaggagctaaaaaaagatgtactgtcgggtgagaaaaataataaagattttcaaattggtgttattcaaataactgatgagaccaatacatcacaaatttgtccaaattgtggttattctatgaataggtacggtctggcgaaaattgaaaatggggaattgaagttaacgctaaatgcggaagagcttaaagataaggattttggaattgatatttctaaggtgactatatttagggtggatgatggcgtgtttgcgtggcggtattctggtgttgctacagagaaattggataaaagtcataatgatttttgtagagttctctcaaaaactagacaaaatgaaacaaaatcaaaggattttattcggtgtgttcattgtgggtttgattcacggttcccaactaaaaatcacgaaaaactaaaaaaggtaaatggtggtgatgtgctcgctgcctacaacattgctaaacgtggtttggaattcattcagtgtaaatcagaagtaataaattaa

SEQ ID NO: 109 - DNA, 4029 bp, Unknown
  Metagenome-Derived Sequence
  misc_feature (1)..(4029): Unk41 Csm1 gene
atgttgacaaaatttgccaatctttatgagttaacaaaaacagtgcgatttggcctcacaccgaaaaatagctataaaaaggtgtcggatttttttgagttgacagaaaagtccttggaaagcgttcaagctgagatagttgaacgcgaaaaagaaaaaataaacataacaagcacagaggaatccataaaaaaaattcgagcatatgttgacgagctcaaaaaacagagtgctcaatggaagacaatttatcaaagagaagacatgattgctgttacgaaagaatattataaaaagctcgaaaaagaagcgggttttgacggtttttgggaggacagggggaaaaagcagccacaaacgagcgaaataatgctatcagcgcttagtaaagaatataataacaaaccaaggagagagtatattataacctattgggcgttgcttttgcagaagacagagcaacttaatagttattttgagccactcttggaaaaatatgaggaatctttatctcgaaaagaacaggcacatctgaagccaaatctggtggattttcgaaaacaatttttgtcattgttgaatgtgagtaacaaatggcttatgccagtcatcaatcaatctatagttttccctaaaatccataatgctagcaagggcgaacaaaatagaaaagtaaaagattttatcagtgaagaagggcgacaaaaaagaatacaattgcaatctatcgggcgaagtttgcgtgatttttttgaggcgaatggaagtcgggttcctttcggaaaagcgacattaaattatttcactgctaggcaaaaaccaaatagatttgatagcgaaatagacgctctaatgttggatttagaaatagaagaaatagtcaggaaagtaaaagatctaaatggagaagaattaaaaaactattttaaatatcagacatacgcaacaggagataaattagatgcattcttaggtcatagttatatgacgcttattgaaaaaattcaacttttcaaaccaaaaccaattccggctagcgttcgtttttccttagcggaaagactttcaaaaaaaatgaatcttccgatggaaaaagtcaccgctatttttgatgagattggaaatcctatcgatattgctagggaatatgaacaagcacttgatcagaaaaattttgatttgaataaatatcctattaatattgcctttgattatgcttgggagagttgtgcgagtttaattaaagggagaatatctgagggtgacttcccaaaagcacaatgcttggcgattttgaaaaaatttaatgcagatggcgatgattttaaattatatgctaatcttcgctatatcagagatgagttggctcctatcgaacataataacccgagtgcggatatagaaaaagaactagtctataatattcagaagacaatagggataatttactcgtccatgccatcggaatatcaaaaatatcttgatattattttgaagtgggttgaaatgccaaaaatcgaaagaaactcaagtgattctaactttatttttgccaagcaaaaaatcggattgttgcgtggtggattgaaaaataaaataaataagcacgctgaaatcacaaataagtttaagaatttatcaatggcattcggtagaagttgctctgatttgcgagacaaattacgcgaagaacatgagctttcaaaaataaaatactacagtgtcctaatagaagattcaaagaaaaacaggcatcttcttatgcttccattagaaacgggtgatcaaaaaatgtccgctgttgaaattgaaaacagattggatattttggagaataaatttgtcgaagatgctccaagtgcaaatgcatatatcgcaagtaaagtatcatcgtttacctctaaagctctggtaaaaatgttaaaaaatcctaagggaagtgaggactttcatattggtagtgaaaaatacaaactgcatgattataataacaagattaaaaaagaatggaaaatatatcaagatgattcaaaatttttgagctatgcaaaaaagtgcttatctgaatcaaaaatggccatgaatcaacattgggaaaagttcggttggaattttgaggggtgcaaaacctatgcagatttggaaaaagaagttgatataaaaggctattctttggaaaagaaatatatttcttttgagaataccgaaatgcttgtgtatgagcagggttgtcttctattccccattgtcaatcaggactatgcaagtgaggtgtgtcaaaatatttttacaggcaataagaatgcttttaccatcgagattgaaaaaggactgcaggaacaagatggctatcttattcatcctgagtttaccattttctatcaaaaaccaaccgaagattataaaaaatccaatcgatatggtcgatttcagctttctgctaattttagcctagaggtgaaaaaaataagcgataattttaaaactaaaaaagaaaagctaaaaaatatccgagataaagatagttttcaaaaagatgtgcaaatattcaacgaaagcataaatgcgcagcttagaattaatgaggatgtatacttctatggaattgatagggggataaacgagctggcgacactttgccttctgaataataaaaataaaatccaagattttattgttttcaagaaagaaaaaaagaaaagaaattctgaaaatcatctaagagaggcaggtgacttctatacgtatgttgattttgaaaaacaaaacattctagatctcacaaatattaaggttgagacttggaatatgcgagatgaaattcatcctaattcaaatttcttgaaacaggcttttaaaaaaatagaggcagatcctgaaatgaaaatgatagcgactcaattaggatatggtattaatgaaaaaaaacaatgcacaattttagtggagtacccgagcgatagaagcaacactttaaagctccgaatgaatcattttcaaagagccttgcaatttgctacttctcactcagaaaaacgagacattgttgggggaatagcagaaagaaattttgagggaacggatcttgaaaacccgagcgatgaagtgaaaaaacaaatcattcaagatctcttcgggcttgggtcagactttttaattgatgaaaagaaggcgggtgtcattaatgagctacagacaaaaaaatttagatttgaaaagatatattcccgcaatcagcagttattcttggaaatgtttgaaccattgatccagcaattgattgaatggtatcagcataaaaatgatcctgattatgagaagacaggaaaggcgaaatatgaagagatggaagatttagacactttgaagcggggtgtgacggcaaatatggtgggtgtattttcatttttgatgcaaaaatttcccggcgtgattgtgttggaaaatattgccaaagaaaaattagaaaaacctgttcaaagcaagctcgatgaacacacgcgagaagttgaaagccatcaggaagcggagcaccatcgttgggcgggggtggagctttatcgctatatggaaaaaaaattggttcaaaaattcagcaattggaggcagccaacaggagaaatttttaacttgactcctccgtttgctaatctggaatcattaaataaacaaacaatgacaataaattcagaaagaattgaaaatatgtttcagtttggaatattttgctatactcccgctgaatatacaacaaaaacttgcccgtgttgtaataaatatcatattaggaatagaaaaaaaggaaatactttcgacagtattatttgcaaaaatgaacattgcggttttgatacgcggtataatgaacctctgcacgaatcatttaatcctgcgcgtaatgtggaaatcgcattgagattaaatcctgaattcagtgaggctttaccaaagattagaagtggtgatcagagtgctgcattcaatatcgccaaaaaaggtctaattattatggaaaataaattatgttag

SEQ ID NO: 110 - DNA, 3504 bp, Unknown
  Metagenome-Derived Sequence
  misc_feature (1)..(3504): Unk1 Csm1 gene (plant codon-optimized)
atggccccaaagaagaaacggaaggttatggagaatttcaaaaatctgtacgaagtccgcaagaccgtcaggtttgagctcaaacccagccggaagaaaacatttgcgggtggcgatatctttgaacttcagaaagacttcgaagaggtgcaaaagtttttcctggatatctttgtttttgcaatcgaacaagagaagctctaccaagaggaggaggaggaaggtaaattgtcgcgctatactaagattgagtttaagaagaagcgcgaaataaaatacacctggctgcgcatctacaccaagaatgagttctacgattggaatggcaagaacgataaagaaaagaattacgccttgtcgaagattgacttcctggagaaggagattcttcggtggttcaacgagtggcaggagcttacggtcaacctcaagaacctcactcagaccaaagagcatgaaaaggaaagaaaaagcgatattgctttcgttcttcggaatttccttaagcgccaaaattttccgttcattaaagatttcttcaacgctgttatcgacattcaggaaaagcaaggcaatgagtctgatgaaaaaattcggaagtttagggaagagcttagagagatgaagaagaacttgaatacatgcgcgaaagagtatctgtcctcgcagtcgaagggggtgctgctccataaggccagctttaattattatactctgaacaagacccctaaggagtatgagaaccttaagctgcagaaggagctggaaatagataacatcctgccgaagaagatttgcaagcgcgtcaggtggaataaagagaagaagcaagaggatatcctcttcgagtgtaacagcgactggctggtcgagatcaagcttggctatgatattcagaaatggacgttggacgaagcttatcagaaaatgaaaacttggaaggccgatcagaagtctgacttcaacgagaagataggaaatttcattgatcaatacctcaaaaagggcttcatagaagacttgatgaatgagaacgagaaaaagaatgctgaagcaatcttgcgcgagttttccgtcttcaagccaatagaaaatttctacttctatgactttcttgaacgcaccaaagaaataaagatcctcagcaatcagaagaataatattctccagaagtacaataagaacgcgaagtactttgaaaagattatcacgtataagataaaggacaaagaggacctcacggaagatgagaaggaataccaggagcttgagaaatctatagagaagaaagcaaaggagaggggcaagtttttcaacgcaccgaaggaaaaggtgcaaacccaacactacttcgagctctgcgaactgtataaacggatcgcaatgaagaggggtaaaatcatcgctgagattaagggtatcgagaatgaggaggtgcagagccaattgctcacgcactgggcactgatcgctgaggagggcgaaaagaagtcggtcgtgttcattcctaggaagaatggagaggagctggagaatcacaaaaaagcccacgagttcctgcagaagcaagagaagaaagagttcggggacattaaatcctatcactttaaatctctcacattgagggctctcgagaagctctgctttaaagaaacagagaatacattcacgcccgagatcaagaaggagacaaatcctaaggtttggttccccaagtacaagcaagagtggaacgacgagcctcagaaactcataaatttctataaacaggttttgcagtcaaagtactctcagaaatacctcgaccttgtcgcatttggtgaccttaagtctttcctggaaacaagcttcgacgacctccagatcttcgagtcagggctggagaagacctgttatataaaggtgccgatctacttttcgaaagaagggttcgaaactttcactaaccgctttgacgctgaggttttcgagatcaccacccgctctattagctccgaatctaagaggaaggagaacgcacacgcagagatctggaaagatttctggtccaaagaaaatgaagagaagaatcatattacccggctgaatcccgaggtgtccgtgttctaccgggacgagattgaaaagaagtcaaacgcattgagggggaacaataaatcaaacattaacaatcgcttctctgcctcgagattcaccctcgttaccaccatcacgattagagctacccacaaaaaaagcaacctcgcctttaagaccgaagaggacatcaagtctcatattgacaagttcaatgaggcatttcagaacttttctggcgagtgggtgtacggcattgataggggactgaaggagcttgcgactctgaatgtggttaagttcagcgacgagaagaatgagtttggtgttattaagcctaaggagtttgcgaaaattccggtttacaagctcaaagacgagaaagcaatacttaaggatgagaacggaaaagacctgaaaaatgcgaagggcgaggcacgcaaggtgattgacaacataagcgaagtcttggaggagaagaaagagcccgatagcaatcttttcgaaaaacagggagtgctctcacagggtatcagctgtatagatttgactcaggccaaattgattaagggtcatatcatactgaacggcgatcaaaagacatacttgaagctcaaagaaatttcggctaagcgccggatatttgagcttttctcaacctccaaaatcgataagaattcggaactgagagtcgaaaagacaacgatatcgatcaattcagaggacggtaaacgcgatttctactggctcacaaaaaatcagatcgtcaactccgagaccaaaaaggagatacaaaaagagcagcaggagaagctggataaccttaaagtgatatttatcgattatttggaagggctttgcgtcaaaaacaaattcgaggacattgagaccattgagaagatcaaccatctgcgggacgccattacggcaaacatggtcggaattctcttccacctgcagaaggaatttaaaggcataatcgctcttgaaaatcttgatactgtgcgcgagcagtctaataagaagatgatcgacgaacacttcgagcagtccaacgaggatatctctaggaggctggagtgggccctttacaggaagtttgccaatatgggcgaagtcccctctcagatcaaagaatcgatctttcttagggatgagttcaaggtgtaccaaatgggcttgctcaagtttgtcgaagtgtcaggcacatcatcgaactgcccgaattgcgacaaagaagttggcaagacaaacagccacttcgtctgcaaaggggagaataattgtgggttcagcagcaaggagaatcgcaatctgcttgagcaaaatctgaacaacagcgatgaggtcgcggcttacaatattgcaaagcgcggcttgaagctgatcaaccagaagtggaataacacctccaagtcacagaactaa

SEQ ID NO: 111 - DNA, 3900 bp, Unknown
  Metagenome-Derived Sequence
  misc_feature (1)..(3900): Unk2 Csm1 gene (plant codon-optimized)
atggccccaaagaagaaacggaaggttatgaattccatcaagaacgagtaccagctgagcaaaacgttgagattcgggctgacgaaaaagaagaagttgctcaaggacgattgtaacgagattatttacgaaagccacaccgagctcaaggagctcgtcctcatctcggagaaaaagatcatggagtcagtctatataaaccagaaggctaagctcgatttgtcagttgaccaaatagatacttgtctcagctctatcaagaactttatcgactcttggaagggcatctatcctagggctgaccagatagctatagacaaggattactataaaatcttgtgtaagaaaatcacttttgatggtttttggatcgatgaaaagacgaagaccaagaagccacagagcaggactatactgctctctgagctctctaagaaagatgcgtctggtaaggaaaggaagcaacacatactggactactggaaaaacaacatctttagcgctattgagaagtacgaggttgtcagccgggagcttaagcaattccagaaggccctgaagatacaacgcacggacaacaagcctaacgaggtcgagctcagaaaactcttccttagcctcgctaacataatattggatattcttaagcctctcgtgaatggtcaaatttgcttcccaaaaattgagaaactcgacattagcaaaacggacaataagaacctgatcgattttgcaacaaaccataaattccagtccgacctgttgaatgagattgctgagctccagcattattttgaggagaacggctcaaatgtgcctttctgccgcgcgagcttgaacccgaagacaatcattaagtctaagctgtcaacggataacaatatcgataaggagattaagcaactgggccttgaccgcatcctcaacgagtacctctcagctccatacttcgacaatagcatcatccaccttagcgctaaagaaaagcttaacaagatagaggataaaaaggaaaattatataacacgcggattgctgtttaagtacaaacctatccagatcatgcttcaccatgaaatagcgaaaaccctgtctaaagaaattggaaaatcggaggagaatattatcgaattccttggcaacataggacagattaagtcgcccgcgaaggactacgaagtgtcaaaggaggacttcaatatcaacaactacccgctcaaggtggccttcgacttcgcatgggagaatgtcgctcgcaacctctatcacaccgacacccatgccccaatcgatgaatgtcggaagttcctggccgataatttcgatatcaagattgaggacaacaacttgaagttgtatgcgaatctcctggaacttaacgccctcctctcaactctcaagtacggtaaaccgaaggatgaaactagcatcaagcaaaatatcaaggacttgttgaacaagatcagctggaacgagattggtaagagcggccagaaaaataagacaaatattgaaaactggttgaataataaggacaaaatagataatcagaatggaatcgagaatgctaaaaaacaaataggcctctttagaggctcgttgaagaataaggtccctaaatactacaagctcaccgagacctataaggacatctctatgaagatgggtaagatatttgcgaccatgcgcgacaagataacagatgaggcagagctgaacaaggtgtcccattacgcgatgatagtcgaggatgataataaagataaatatatcctcctccaagaattcacggacaagaaggaggagtgcatctattctaagacacagacccacaacagcgactttacgacatattcagtgaactcaattacatcctctgcgattgctaagatgataagaaaagtcaaggctgaggagctgcgcaagaaccagtataataaggatactttctctatcgaggaaactaaagaagagaaggagaacaggataattaaggaatggaagcagtttctgaaggataagcaatgggactatgaatttaatcttgataccaaaaataagaacttcgaggaactcaaaaaagaaatcgattccaaatgctacaaactcaatatctcgtatatcgataagaagactatcacggatctcgtggaaaataagaactgtcttttgttgccaataataaatcaagatctttccaaagaggaaaagacgcaaaataaccagtttacgaaggattgggatgccatcttttcacagaataccccgtggaggctgacgccagagttcagaatctcctatagaaagcctacaccgaactatccgatatctgataaaggtgataagcgctactctagatttcagatgatcggacatttcctctgtgattacatcccgcagagcaacacctatatttcgaatcgcgaacagatcgctaattacaaggacaatgagaagcaggaacaagctgtgcaatgttttcacgacaaactcttgggcaagacagaaaaggaggcgaagaatgaaaaactcatagcactgcaagctaagtttggatccattagcagaaccaacatcacgcaggagaagaagaaggagaagttctacgtctttgggattgaccgcggacaaaaggagctcgctaccttgtgcgtgatcgatcaggataagaagatcattgatgatttcgacatttacaccagaagcttcaactcaaagaccaagcagtgggaccacactttcctggaaaagagggctattatggaccttagcaacctcagggtggagacaactatttcgatagacggtaagactgagaagaaaaaagtgttggttgacctctccaaagttaaggtcaaggataagcaaggccattactccaaaccggataagatgcaaattaagatgcagcaactcgcatacatccgcaagcttcaattccagatacaaaccaacccggacgtggtgctcgcctggtactcggacaacaacacacaggatctcatactggagaactttgttcgcaaagacgacaacgacaataaaggactcgtgtcgttctacggggcagccgttgaggagctcaaggacactctccctatcgaagagatcctgaacatgttgaagcagttcaaggagctgaaagagaaggagaaggcgggtgagaacgttaagtacgagattgaccgcctcattcaactggagcccgtggacaacctcaagacaggagtggtcgctaacatggtcggagttatcgcatttttgctcgagaagtttaactatcaagtctacatatcgctggaggacctgtctcaaccttttgacaacaagattaacggaggtatcacgggtgtgccgattaagacaaataaagaatcggggcggatggccgacgttgagaaatatgcaggcctcggattgtataatttcttcgagatgcaactccttaagaagctctttaggatccaacagaagagcacaaccatactgcacctggttccggcatttcgcgctcagaaaaactacgaccatgttactgtcggccaagacaatattaagggacagtttggcatcgtgttctttgtcaacgcaaacgccacgtcaaaaacctgtcctatctgcggagcgaacaactcagaaaagccagacaaaaacaaatatccgaatgcgcacaaagaacttgcgaaagacggcaaggaggtgtggatcgaacgggataagtctaacggcaatgacatcataagatgcttcgtctgcggctttgacacaaccaaaacctacgaagacaatcctgctaagttcatcaaaagcggcgatgataatgcagcgtaccttattagcgtgtcggcaatcaaagcctacgagctggcaactatcctcgcgatagagaaatacaagtga

SEQ ID NO: 112 - DNA, 3303 bp, Unknown
  Metagenome-Derived Sequence
  misc_feature (1)..(3303): Unk3 Csm1 gene (plant codon-optimized)
atggccccaaagaagaaacggaaggttatggctgggacaccatatactggccacgtcgcctgcaagtattgcaagataacctcctgggcgacttacgatcgcattaagatcaacaagattaacatgaatcagtcatttattaacggacagaacttctatgaactgagaaagactatacggtttgtgctggacccgaaaactttgaaaaggccatacactccctcgtcggacgaggtcaacctcgaggagcaactcaataactttatcgaaaagtaccagcaagggataaatgatttcaagtacatcgtttacttcggcccaaagacggcggaaaccaaggagctgaataagaagatctccataaagcatagctggctcagaaattacaccaagagcgagttctactctatcaaggacaagctcatccagctggattataacggcaataaagcgagcattggcaatagcaatctgaagttcctgaatgagtactttgagaactggatctcggaaaatcaagagtgtgcggatgccctcaaaaactgcatcaacgccccggccgagaagcagaagcggaagtccgaggctgcacattgggttcgcaagctgaccaagcgctccaactttgaatgcattttcgaacttttcaatggtaacattgatcacaaaaacagcaatgacgacatcgagaagatcaagcactgtctgaacgaatgcaagactctccttacatccctggagaagatgctgctgccctcgcaatcactcggaatggagattgagcgggcttcattgaattattatacaatcaataagaaacccaagaattatgacgaggacatcgcccagaaagcttccgccttgaatgaggcatatcagtttaaggcggacgacaaggcattcctcaatagggtcggattttccgacgatggcgtgccaataaatgagcttaaggaagcaatgaagaaatttaaggccgatcaaaaatctaaattttacgaatttgtgaaccaaaagaagtcctactctgatctcaaaaagaacgacgatctcaaactcctgaacgatatttcggaggaggacttcaataagttcaaagagacacaggacaagatgacccggggtaagcatttccaattctctttccccaactacaagaaatccgaaaagaatttttgtgacctctataagaacgtggcggtcgctttcgggaagattcgggccgatattaaggctctcgagaaggagagaatggacgcggagaagctgcagtgctgggcagtgatcctggagaaggataaccaaagatatgtcgttactatccccagggacgccaataacaacctgacaaatacaaagcaatacatagacaatttgcagaacgaggaaaatgaccaatggatcctctacgccttcgaatcccttaccctccgcagccttgataagctttgttttgggttggacaaaaacacatttattccggccattactggtgagctttatcagaaaaataatagctttttcgagaagggacttctcaagaggaaggaccaattttcacagaacggcacggatctcgccgcgttctataaaaccgttctcgagctggactccactaagaaaatgcttggcataaataaatatgctgactttaaggctttcatctcaaaggagtacacggctctcgaggactttgagaaaacgctcaaggagacttgctattttaaaaagagagtgttcataagcgaggacacaaaaaacaaactcatcaatgattatcagggaaatctttataaaattacgtcctacgatctggagaaagacgattctgaggctctcgggaccctcataaataaaaaacagttcaaccgcgcatccccagaaattcacacaaagacctggcttgacttctggacggccgataacgaaaccgataagtatcccattcggttgaacccggagtttaagatctcttttgtcgagaaacaggataaggacctcaacatgcggaacttgggcttgttgaataagaacagaagactgaagtcccagttcttgctcagcacgactattacactgcttgcacacgaaaagaacgccgatttgcacttcaaaaagactgatgagatccagacgttcattaactcgtacaatcaagagtttaacaagaagattaagccattcgatatttactactatgggctcgatagaggacagaaggagcttttgaccctggggcttttcaagttctccgagaatgaaaaagtttcgttcaccaagcaagacggcacggtcggcgagtacagcaaacccaagttcatcccgcttgatgtctatcagatcagagagggccagtacctcactaagaataagaagggcagacttgcatacaaatccatagatcaatttatcgacgatgagaaggtgattgagaagttgcctgtgaattcgtgtctggacctctcatgtgcaaagctcgtcaagggaaagattatacagaatggcgatgtggcgacataccttgagctgaagcgcgtgtctgcactgagaaaaatttatgaaaacaccactcgcggccaatttaagacagatagaatcgggttcaacaaggacaaaggttgcctttttcttgatattgaaaaccgggggaagcttgagaacaacaacctgtacttctatgacaacaggttcgctgaaatcctctctttggacagcatcatcaaggagctccaggactattacaacgaggtcaagaataagcagaacatcgagtttatcagcatcgataagataaaccacctcagggacgcactctgtgctaatgcagtgggtatactcgcccatctgcagaagactcatttcggggttattgtgtttgaaggattggatgcgcgccacaagaataaggagacaactgaattcgccggcaaccttgcgagccgcatcgaaaggaaaatccttcagaagcttgagactctgtccctcatcccgcctcagcaccgccagatcatcgacttgcagaattcgaagcagatcaagcaaacaggagcggtgctttacattgaggaaaagggaacatctgcaaactgcccccactgcgaaacggccaaccctgataaatcagaaaagtggctcgcacataattacaagtgcaaaaattccaattgcaacttcgatgcctcagagatctctaaaaggaaggatctcatcggactcgataactcagactccgttgctacatataacatcgcgaagagaggtctgctcgaaatgaatcagaaaattgagcaatcaaaagtttag

SEQ ID NO: 113 - DNA, 3354 bp, Unknown
  Metagenome-Derived Sequence
  misc_feature (1)..(3354): Unk4 Csm1 gene (plant codon-optimized)
atggccccaaagaagaaacggaaggttatggaaaaattcaagattactcggaccatcaggttcaaggctaacccaatctccattaataagcttcaagaccagactaaatcactttctgagaactctgaagcagacatcgttgggattattaataacgctaaccagattatcaatgacctggagggactgattttcacaaatgaggagaaaaataatctccgcaaggatgttactattcatttccggtggatccgccagtatgttaaaaacgactggtacgcatggaaggaaaagcagacaaataatagcaagcaagctgagaagggcaaatcaaagagcgcggagaaggatcagctgaagagccccctggcgcagttggcactcctgcgggataaattccccgatgctcacaagacatccaagacaatccagtctagctcgcctaactccaataaggaatcttcagaaaaaaagttgccactcggtgacgtgccattcctcaaggaggaatttacgttcttctgtaattattggcgggagatcgccgagaagctgaatgaggcgtattcaagggaagaacataatcgcatgaggcgggcggacattgcaaagcacttgaacgaactgtcaaaaaggcagatcctgccattcctctcggacttcttggccaacggcaacgacaaaaagaacgatgagaagatcaagaatctcatcgttaaggtcattgagtttaagaaggacctggagattgctaagaacgcctatcttagcgcgcagagctcaggcataatgcttgcacgggcaagctttaattattataccctgaataagaaacccaaagatttcgatagcgaagagaggcgcataatcgagaacatgaatgccaagtactatcagccggggaacattccacagatcattaaggaccttaagatagacggctctctttctattgagaaactgtatgaagagcttaagtcatacaaggccgaacagaaagccaagtttcaggaggccatttctcagggactgaagtttgaggagctgcaggcaaaatttcctctctttgaaactacgcaagaaatcttcaacgactatgtttccaaaacaaatctgattacgcagaaggccacacaaaagaacaacactccgaaaggctccatggagttcaagagactccaagacgaaattaataagctcaaacgcgaaaggggtaagatgctccagcagggcaagttccggaacttcaaagcgctgaatgaggagtttaagagagttgcggtgaagaagggcaagctgaaagcgcagttgaagggtatcgagaaggagaggatcgattctcagaggctccaatactgggcactcatcggtcaggaagagaataaatataaacttattctgatcccaaaggagaacgtttccaaggcttatacagaaattgtcaaccagcgctggattgacgacagagtctccatgtacctttactacttcgagtcttttactttccgcgctctgaggaaactctgcttcggcgtgaatgggaacaccttcatgcccgaaattaagaatgaactgcctaagtacaaccagcaggacttcggcgagcacattttcaagaccgaagacgggaagggcgacgagaaggccttggtggaattctatcagcaggttctcaagactgattttgttctgaagaaccttgctctcccgcaccagcagatggaggaggttacaactaccacattcaaagacctgaattctttcaagattgctctggagaagatatgctacaataaaaagatggtcgcctctccgagggttctccgcaacttggaactgtcttatggcgcagaaatcttcgagctctcatcacaagatctcctcaaagaacactccactaatttgaaaaaccacacaaaaatttggaatctcttctggtctaaagagaatgaagaaaagaacttcgatacgcggctgaatccagagatcggaatcttttggagggagcccaaggcatcacggattgagaagtacggggaaggaacggcacactacgaccctcagaagaaaaaccgctatctgcaccctcagttcacaatcgcattttcgataaacgagaacgctctttctaacgatttgaactacgctttcgaaggtttcgagaaacagaaggaggctatgatggagttcaaccaaaagattaataaggagttcaaagacggcatggagcagaaaaaattgggcgcgtttggtgtcgatacgggggaagcggagctggcgaccataggtctcacagataacgggaaaccttttcccgtgaaggtcctcaaggtgaaatcagacaaactcaattattcaaagcaaggctacttcaaagacggagcaatgcgcgaaaagccatacaaggctattgacaacctgtcatactacctgaagaaggatctctacgataagacattcagggacgaccacttcgagcagacgttccgcgagatattcgaagagattgaaacagaaactatcgacttgacttccagcaaattgatatgtgagcatatagtggtcaatggagatctccacactcgctcaaaactcaacatcctgaacgcaaaacgccaaattaggcaagctctgatcacaaatcctaatctggagatcaagtttgaggacaataaaatcttgatctctgagacagatgaggagaggaagaagatcaacccttggaaggccgtgtatcataccaacgaagaactggaacagataaagtacttcgaggcagtcaaagaggagattgaacagtacctcaagaaggtccaagacgattcagcagaggtgctccaaaatattaacagatttcgcgaagtggcagcggggaacatgacgggggtgatcttccacctttataataagtaccctatcctgatcgcaatcgagaacctggcccaaggcaccatagagaagcaccggctgagatacgaaggtgttatggatcgccctctcgaaagagctctttatcgcaaattccagtcgataggcctcacgccaccggtttcggacctcattgctatcagagacaacctcactcagaagaaaaaggataaaatgtcacaactcggtgtgctccaatttgtcgacgaacagaatacttccaaaacttgcccacactgtgaaaagaacgcatatgagggcgagcgcaagaatttgtacctcgaagagaaaaaaaaaggcattttctcctgtgggcactgcggataccaaaacataaacaacccaatgggtctgtcgctgcactcaaatgacgcagtggctgcctttaatatcgcaaaacgcggtataaagaacctgaagaagtaa

SEQ ID NO: 114 - DNA, 3369 bp, Unknown
  Metagenome-Derived Sequence
  misc_feature (1)..(3369): Unk5 Csm1 gene (plant codon-optimized)
atggccccaaagaagaaacggaaggttatggccggctttgataaacttaagaaccagtacgaggtcaaacgcactatcaggtttaacctgacccctgttcatttttcatataagaaaatctcctctgagtcattcgaatccaagttgaaggaattcgtgtctgtttatggcgacgtgatcgactccttcaagaggatgatgttcatagaagagtatggcgagatttcgctgaaccgcgacatccacgtgaggcatgagtggatgaagatttatgccaaacaggatttccaccttaacaaggaaatcatagtcagataccggaagaaccgcaaaggggaaaacataaagtctaacacagatacaagcctggagaagacacctttcatcttcgacctgttcaacaagtttctgatggacaacttgtcgagcgatgattataaggacggtattctgtccaatcttgaggtcattatcagggaaccgctggacgaaaagtctggaaagtcaaatctgtcctatctccttaacaaaatccaaaagaggtcaaatttcgagtttatataccagctgtttaaaaatatgcaatctaaaaagtctgacttcgaaatagaagagtgtaagaagaagctcgaccggtgcaaggagcttctcctttcactcaaccactaccttaccccaaagaattctagcggtctggaggtggagcgcacttctctcaattattttactgtcaataaaaaaccgaaggattacaagggagagaagaaacgcatttatgataagaagaacatcccaatcaataaccgcgtcctgaacggcaatcagtccaaatacaatgaagttcttaaggaatccggtttctacaaccgctacaacaagaaaaacttctccgatttttctctggaggagttctataaaaacctcaaggagtttaaggccgaggagaagtctaagttttttgaacttattaacttcggagctagccttaatcgcattaacgaggatatcccacttttcgaattgtcagacattgaacgcggcaagaataaagagctcagcttcgattcctttcagaaggagaccgagaagatcaagaaactgtcggacgacctcaatggccagctgaacgacacactcaaaaaagaaatcaaagagctgaaaataaagagaggccggttcttcaacgtcaacgacgatgagaattgcccattccagaggtacattacctacactaagctctatagggacgttgcgatggagtatggtcgcattaaggctgacaccaaaaatctggaaaaagaggagattaatgccgagcgcctggcttcttggtctgtcttcgtgaagatagagaacggatacttcctgatgactataccgaaacacaaggacaatcactcttcactttcgtccgcctactacgatctgaaggatacaaagtctgtggatggggagtacaatatctatatcacggagtctctgactcttagagcactggagaagttgtgctttgggctggataagaacacgtttgtgaacgaggacttcctggaggaactgaacatgctttcacccgaatacatagtgcataaagacggtaagaaatccataaaacggaaagacgagattttgaaggagtcagaacttaagctcattaatttttacaagaaagtgctctccatgattaccactaagaagaggatactcatcaatgattttaaggacaattcttgtaaggataactacctgagcggtgacatcaagacgttgcgcgacttccaaattgcgctggagaagaagtgcttcactagaaaggaggttagggtctctaaggattttctgaacgatttccgcaataaatactcggcaaagctttacaagatcacttcgtttgaccttgagaaaagacgcgaaaatcccgagtctcacaccaatttgtgggaaatttattggactcagtcgaacgaggggggatataccacgagaataaatcccgaaatgcggattaacttcatagacaaaagggaggagtcgattaaggataaatctggtaacgaggtcgaaagaaatcggcggaaggataaagagttcatcctcagcctcacgatcactgaacacaatgacaagcctaagttcgacatggccttcgccgacaaaaagaaggtcattaagaatataaacgacttcaacacgacactgaattctaagctccaggacggtaagctggggatatattattacggactggaccgcggtgaggctgagctggttacactgggagcgtttaagtttctggacgaaatagttaaggttgatactgggtgcctctataacaaaccgaaggcggtgaagattgatgtttgggaactgcccgaggataagctgatggagcaggtgccctacgaaactaagtctgggacaatgtattttgacgcttacaaaaatatatcgaagtgcgaacacctcttgatcaagaaggagactgaatcctgcatggatttgtcctgtgcaaaggtcatcaatggcaaaattgttctgaacggtgatatctcaacactcattaatctcaagctggaaaacgccaaaaggaggataaacaaccatttgtacgacttcatgaaggcaaagtacaagaaggacggcaaggttgatattcgcatcgaatacaaggaaaagaccaaaaacaaaccggaacgctttgacctctatataaataacggcgaattcaaggagctcggaatctattatcctaagttcgccatcgagaaaaagattgccatgacgcaactggaccagtacatcgtcgagcttcgggatataatcaataaccagaaatccgtcggactgaacatagagctggagaaggtcaaccacttgcgggacgcaatctcttctaacattgtgggcatccttaactttctttataaggactttccgggcttcatatccctcgagaacttggagactgacgacaagaacgagaaacttgggaaatcaaaggttaaccttgcgtctcgcattgaatataaactcctgaataagttcaaaaccctggggctcgtgccccctaactacaagatggtcatgagcctccagtcaaagagagacatctcccaactgggtatcttgaattacattgagacgtccggcacctcatccaactgcccgcactgtggacagtctatcaatgacaaggagcgggaagagaataagtggcggaaccatcagttccgctgctcccattgcggtttctcttcttatgagaatgaggatcataaagggctggacttcttgaactcttcagatgacatagccgcttacaatatcgcaaagcgcggcttggagtacattaactcacttaaaaagtga

SEQ ID NO: 115 - DNA, 3795 bp, Unknown
  Metagenome-Derived Sequence
  misc_feature (1)..(3795): Unk6 Csm1 gene (plant codon-optimized)
atggccccaaagaagaaacggaaggttatgaaccatatttataataactaccaggtttctaagactctgaggtttggccttacacagaaacagaaaattagacgccccggctacacgggcgaactttatgaatcccataaggtcctgaaggaacttgttaagatcagcgaggagaaggttaagaatctgatagtgcccgccaagaacgaggaattgcttagctcgttggattccgtgaagtggaccctgactgagatccgcgagttcctggaccagtggcgctacatatacaacaagagcaatcagatcgctctcgacaagtcatattatctgattctttccaagaagctgggcttcaacgacgaaaagaagagcagggttataaagatgatcgagataaaggacgatattaaagaaaaaatcataaattattgggcattcaatcttaacgagtcgaaccagaagctgctcatggtcaatgagatggtgaacacgcagcttaaggcactcgagatcaaccgcacagaccacaagataaatgagatagaactgcggaaggccctccagtcattgtttaatacagtgcttgatatcttgaagcctctggtctacagggaaatctcattcatcaacctggaaaagatagaaaaggactcgaagaactctctgcttgaaaagtttgcaactgatttccagcggaagatcgacttgttggagaagattaggtctctcaaaacacatttctctgagaatggtggtaatgtgagcttctgccgcgcaactttcaatcctaagaccgctattaaaaacccgaagtcgaatgataatagcattctcaaggagattaagaagctggggatcaaggacatccttgaaaacaatgagaatgtcttttatttcgagaaaaagctcgcggagattacagcgaaagaaaagctggagtacatcattaaggactccgaaagctttcttatccggagcctcttgttcaagtatatttctattccagctttcctgcatcatggcatagcaacagagctggccccaatcatttcaaaggagaagaatgatcttatcaactttatgattagcataggccagatcaaaagcccagcgaaggattacgcggacattcccaacaagaatgatttcaacgtgaatgcatacccgattaaggttgccttcgactacgcctgggagacggtggctaaatcgcagtaccaccatgacatcaacgcccccgttagcatgtgcaagacttttctggatgagaactttgagaactgcaccaagaccaaatatttcactctgtactcagaccttctcgagctccacacattgctgtctaccctcgattatggaaatccatctatggaggatagcataatagacaaggcaaacaaaattatcgcaaagattgataataaggaacacaagactaaggataaggacctcgataaggatatagacaagtacaaagaaacaattaaaaatcggcttaatcacaaaaatttcaacgacaaacagcgctactccgacgctaaaaaggagctgtcgcagtttcgcgggaaactcaaaaatgagaacgatatttatcgcaaattgacggagagctataagaagatcgcaatgaacaccggaaagatcttcgccgagatgagagacaagatatccaatgcttccgagcaaaataaaatctcccaccacgcacttatcatcgaggatcacaataaggacaggtacctcttcctccaggaatttactacggataaggaaaagcaaattgagtcaatctgtaacgaccaggcaggccagtacattgtgtactgggtgaactcaatcacgagcaagagcatttctaagatgctgtcgaaaaagcggattgagaagctgaagcaaaagaagatcattaataattccatcaaaacctccattctgtcagacgcggagaaagaggcccgcgacataaaggagtgggtgtctttcattaaagaaaagggatgggacatcgacttcaacttggatctccagaacaaaaacctggaggagatcaaaaaagaggtggatgctaaagcgtacaagctcaaagagacgcttataagccagaaaacactctctaatctggttaaagaaggtaactgtctgctgtttcccatcattaacaaggaccttgtgaagaaagttaaaacagagaagaatcagttcactaaggattggaacagcattttcaaaaaagataatctctggaggctcacgcccgaattcagagtgtcttaccgccaagctacaccaggctatccaacatcggacataggaacaaaaaggtatagcaggttccaaatgaccgcacactttctctgcgacttcttgccacagggcaccaaatacatctccaaccgggaacaaatagaaaactataagtcttccgaaaagcaaaaggaagccgtcgagatttttcaccagcagattgagaacgacaataataatgtcatttccacacagtcccttaaccatcttgccaggcacttcggttcaaagaacataaagaagaagcacaataccatagagaaaaagttctacgtgttcggtatcgatcggggccagaaagagttggctaccttgtgcattatagaccaggataagaaaatcgaaggtccgtttaaaatctacacacggtcttttaacacgaagaccaagcagtgggaacatcagttctacgaggaaaggtacatacttgatatctcgaaccttcgggtcgaaacgtctatctcgattgatggcaagccagaccagcagaaaattctcgttgaccttagctactacaaggagggcgagaagttcatcaagctccctaagatgcaggtgaagctccagcaattggcatacattcggaaattgcaataccagatgcaaaggaaccccgaaacggtgctggactggtcctacaagaacaccgatgataagtctatattggagaacttcgtggacaagcctaacggggaaaagggcctggtttcgttttacggagccgcggtgatagaacttaaggacaccctgccactttccgagattaaagatatgttggagcggttcaaggagctcaaggggaaggaaaagaacggcgaggacgtttcacaacagctcaatgaacttacccagctgaagtctgtggatcactccaaatacggtgtggttgctaacatggttggggttatagcccacctgctcgagcggtacgactacaaggcctacatctcgctggaagatttgaccaagccctattcagcgattgatggaatcaccggtcaaaaaactgatgccaagtctatctccgggaagcaacaagacgtcgaaaagtacgcggggttggggctttacaacttctttgaaatccaactcctcaagaagttgttccgcatccagaaggactcacagaacacattgcacctcgtccccgcgtttcgcgccacaaagaattacgagaatttgatcgcaggggaggataaggtgaagaacagattcggcattgtttacttcgtggatcctaagtctacttcgataatgtgtccttcatgtgggaagacaaataattcgtcaaataaggaaaagagagttgtgcgcgataagaaaaatggaaacgacattatatactgcgagttttgcggatttgatacgagaaacgactataaagaaaatccactcaaattcataaaatccggggatgataacgccgcctacatcatatccacacacactgcaaaaaaagcgtacgaactggcaaagtctatcttgtga

SEQ ID NO: 116 - DNA, 3795 bp, Unknown
  Metagenome-Derived Sequence
  misc_feature (1)..(3795): Unk7 Csm1 gene (plant codon-optimized)
atggccccaaagaagaaacggaaggttatgtcgctggccgctttcaccaaccagtaccagttgtcaaaaaccctgcgcttcggtttcacacagaaggagaaggttcggaaggagaatttcgacgggtcgatttaccagtctcacgcagcgctgcgcgagcttacgatagagtctgaacggctgataaagggaaagctgaaaagcaatacggacaccgctctcccgctggaaaagattcgggcgtgcatcgaggagatcaagcgctatactgacacgtggagcaagatctttacgagggatgatcaactcgcactctccaaggagtattacagggttatggccagaaaggctagattcgacgcattctggaagaactaccgcgacgtcaaacaaccacagtcccagatcgtccgcctttcatctctcaaaagcaagtacaatggcaaggaacgcaaagcctaccttgtggactattgggcagggaatctccaaacagtcaagcaacggctcgtggatttcgagcccgcgattcggcagttcgagtccgcgttgaaagataataggactgatagaaagctgaatgaagtggacttccgcaagatgtttttgtcaatttgcaagcttgtcaatgaaacacttgtccctttgtgcaactcttctctctgcgtcccagacctcgagaagcttcttgacaatgaggcgagccaagagctgagggacttcgtcatgatggacattttccaactgcaggaacaaatcgaggctcttaagatttacttcggcgagaacggcgggtatgtcccttacgggaggaccacccttaacaaatataccgccttgcaaaaaccccatgcatttgatgaggaaattgaggccatcctggtcaagttgaaactgagcgacgtcataaataatcttataaaacaagacgacgtgagcgactattttgagaatgtgaaagataagatcggccagttgtcaaactccagcatgtctgtcattgagtgcgtgcaactgttcaaatacaagccaataccggtgtctgtgcggtattcgttggtcgagtatttccataggaagcttggcatcgacaaggacgagttgggcacactgctggacacgatcggaaagcccaagtctcccgcaaaagactacgcggaccttcaggataagggcgattttaatctgtacaagtacccccttaaggttgcgtttgatttcacctgggaatcgctggccaaggctcaatatcacgaaggactgaatttccctgaggtgcagtgtcagaaatttctggaaaatattttctttgtcaacacatcatgcgaggctttcaaaacctacgccctcttgctccacctgcgcggtctcttggcgaaactcgaccatgaggagccgaacgacagagaggccatcatcgataaggccatctctctcatgaacgaggacgcgttccccaaggtcccgcttcgggggaccaagggcgactccgcaaatcaagccattctgtcctggcttcaactttcaaaggaagagcaagtgtataaaaaggagaaaaaggaccagtcctacaaccagtatgagaaggccaagaataaaattggtttgctgagaggcgaacagaaaaacaagatcggcaagtatcgcgaagtgacagaacagtttaaggatcttgcctcgaatttcggaaagctgttcggtgcgctgcgcgagaagtttcaagcaaaaaacgagctcaataaaataactcattacgggactattatcgaggacaacaatcaagatcgctatgttctgctctatcctctctctgagggcattatcgatctggataaacttttcgtccatgaggagtcggggacactgacgtcatactatgttaaatcgctgacatcgaaaaccctgaacaagctcataaagaataaaggtggcttcaaagattttcacatggatggccaacagccggattgggaacgggttaaaaagagatggtccgtctacaaggacgataaggcgttcctcaagtatgtcaaaagatgccttaatgagtcagagatggctaaagcgcagaactggggggaattcggttgggatttctcttcttgtgattcttttgaagaaattgaacgcgaggttgacaaaaaaggctacagcttcaagaacgacaggaaactttctgaggatactgtgaagcgccttgtcaaggaggaaaaatgtcttctcctcccgattatcaatcaggacatcatagtcgaggagacgaaacttagaaaccaattctcgaaggattgggtgaatattttcgacgctgactgcactgagtacaggctccaccctgagttcggcatgtcttaccggatgcccacgccaaattatcccaagccggaacagaagcggtatagcaggtttcaaatgatcggttactttcagtgcgagatagtcccaatcaagacggagtacttgagcaaaaaggaacagatcgagatcttcaacgacgctgatgctcagaaggaggcggtcgagaaatttaacgagatcgttaacggaagcgtgaagccgaacgattacgtggtcatcggaatcgatcgggggttgaaacagctcgcgacactgtgcgtgttgaacaaagacggtgccatccagggagggtttgagatttataccaggtcattcaacgctgacaaaaagcagtgggagcacaggtttatggacaacagagacatattggacctctctaacctcagggtggaaacaacagtggacggcaagaaagtgctcgtggacttgtcgtctattaaggtcaaggaccaaaggggcaactacacgcaagataaccagcagaaagtcaaacttaagcagcttgcttatatccgcaagctgcaatatcagatgcaagttaatccagagaaagttaaagcctttgctgctcagcacaggacgccgcaagacatcaaggatcatatgaaggagttgataaccccttacaaagaagggtcgcattttgcagacttgccgctggaccgcattaaatatatgctggaggcgttttgtgcattccacacagagaacgaccagacctcactccgcgaactcatcgagctcgacgcagcggataatcttaagtcaggtatagtcggcaatattgttggcgtcatagcattcctgctcaagaggttcagctacaatgcatacatatctatcgagaatctgactcgcgccttttacaaccagcgggatgggctttcagagaaggaaatcccaagagatcacgacttcatggaccaggagaacttggttctggccggcctgggaacataccactacttggaagttcagctgctgcgcaagcttttcaggatacagtgtgatgctggcatcattaacttggtccctgcgtttaggtctaacgataattacgaaacaactcgcaaattgagcaagaaacagggggttgagtatgtgtgtaagccgttcgggattgtccactttgtggacccaatgtacacatcaaagaagtgcccagcctgtggaggcactacagtgcagagggggagctttaaggacgacattacctgtcagaacccactctgcggttatggcacgtcactcgacattagcgagaagattcaaaaactgatatctgccaacaaagccggtcaaaatattcacctgatttcaaacggcgatgagaatggcgcctatcatattgcgctcaagaccctcaagaacttgtttgggaacatccagaatgctaacaatgagcgccgctacgttaagagcttccggagcaaatga

SEQ ID NO: 117 - DNA, 3168 bp, Unknown
  Metagenome-Derived Sequence
  misc_feature (1)..(3168): Unk8 Csm1 gene (plant codon-optimized)
atggccccaaagaagaaacggaaggttatgacccatcaatacgagtttactagaactataaaatttaacttgaataacaaaaaggacaacgatgctgcgcagcttaagaaattcttttctgatgaacacatcaattttcaggagcttttcaatgacttcgagggctcctttagcgcacttctggatcaatttaaaaaggccgtgtacttgaagtccgggaacaatttcgggaacaatctgagagttaaaaatagcctcgaaataaagaagtcctggcttaaacagtatgcaagagacgagttctacaagatcgacgaaaaacagcgcaaatataacaagtttccagcgaaccttttccaatcgattttcaatggatggttgaagcgcaatgagtcgctgcttgagcagtttaagaagatcaatcaaatgccgcaagaaagccagataaagaggagcgaaattcttactctcctgcaggagataaaaatcaccgataattttttgtttatcaaaaattttgtgcagccgggtatagcaaacgacaagaactccgattctgacctggaaaacctgaaggaaaaggtcgaccagtttgaaatacttatgaacaaggcaatcttcgcaatggccccagacctgtcccagggtgttgaggtgtgtcgcgcttccctttcctattacactgtcaacaaagtctctaagagagatttcgacacagagctcgaggggaagcgcaaggagctgaagcagacatataataaggagctcaaccagcagctgctccaaacggtgggattcctcgattatctggagaatgagtatcagtctgacattcagctcgtgtcgattcaagacctctacaaagcactcaagaaattcaaagcgcaaaaaaaaagcgagttcatgcaagctgttcaacaagggaaacaggcggaagaactgattaaggatttcccgctcttcaatgttcagaaggatgttatgcaaaacttcattaatatttctaacaaaatcgacgagaagaacctgcagaagcaaaaaagccaaaacgagaaggaaaagaaggggctgacggaggagataaggaagctccgcatcaacagaggtaagtatttccagaatagatggggctttccaaattacgttaacttttgcaacaatgtcttccggccagtcgccattaagattggtaacctcaaagcacagatcagagcaatcgaacaggaaaaaatcgaggcacgcctcttgcagtactgggcacatatcctcaagaaagggaaccaatattacctgttgctcatccctaaagagaagatgcaagaagtcaaggatttcctgaataacagcagcccgtctcaggagggtgagtatactctttattccttcaactcgctgacgcttagggcgctcaagaagctcatcaggaagaatcttggcaaggagcagacgcatctgcagaacgataatacagcaattgaactctacaaaaaggtcctccagggtaagtactcagagctccaaaatttggacttctcgggattcgaagagaagatcaaggaaatagttcaaggtaactacaactctgaggagtattttcgccttaagcttgaaagagtggcctactgctgtttcgagcagaagatttctcaggagacaattgcgcatctgcacaggagcttttcggcgctcctgctcgagatttcggcctatgatttcgagagaaacatttcctcaaagatgaaggaacactctaaggtgtggcaggaattctggaccgtcgaaaataagaatgagcacttcccaattagaattaaccctgaaatcaggatcttttaccgccccaagagagagcaagaggatcttcagaagggcaagaaccgcttcgcaaaggaccactttggcgtcgccttcacaattacacaaaacgcagcacagaagaatcttgacctggcatttgcgaaggagaaggagatttcagaagccgtcaagaagttcaacgaggagataataggagagtttattaaggaaaaaggtaatgatctgtactactacggcatcgatcggggccaacaggagctggcaacactttgcgtggtgaaattctcagagaagcaagggaaaaccaaacttgcgaatggcgagatgcggaagttcaatatccctgtgccagttcccatcaagctcaagttgtatagaataaaggaagattgcctcaattctgaaaaggagatcatcatcgatcgctatggaaataagaaaaacgtgaagatgttcgaaaacccgtcctactttatcgatgaaaaggagaagttcgaggagattgagtccacgtgcttcgatttgacgacagccaagctcatcaaggacaagattgtgctcaacggtgacgtgcgcacttacattgagctgaagaaggcgaatggcaagaggcaactttttgaaaagctctccaagatagaagataaggcggagattgagttctgcgaggacgaaaatggaaagcgcttccagataaaaagcaaaacaacggagatcaataaataccagtacatcatcttttactctcctgaggatgagaagatcatgccgagggatgaaatgaagaagtacttgcaaaactacctcaacaatctccggaacggaaacctggcaaaggagaacatctccattgaaaaaataaatcatttgagagacgccatcactgcgaatatggtcgggataatagcgtatctgttcctcttcaagaagtaccaaggcataatcaatctggaaaacttgatcgagactcacttttcccagaacaatgagaacatcgagagacggcttgagtggagcctgtataagaaattccagaaattcggcctcgttcctccgcagctccgccagactgtgtttcttaggaaagagaataatcagctgaatcaaattggaatcattcacttcgtttctaagaaaaatacctccgcgtgctgtccgcggtgcggtaatattgtgccgatgcgcaagcgggagacagacaagttcaagtatcatactttcatatgcgataaatgcgggtttaacactcaaaatcccaaatctccatttgacttcattaaaaatagcgacgaagtcgccgcttataacatcgccaagtcgaatcttaacaagttctattataatggttag

SEQ ID NO: 118 - DNA, 3372 bp, Unknown
  Metagenome-Derived Sequence
  misc_feature (1)..(3372): Unk9 Csm1 gene (plant codon-optimized)
atggccccaaagaagaaacggaaggttatgctccagaaaggcacttcaaagatgctcatccagttcaagaatcattactcgtacaataagagcattcgctttaagcttgagcacaagaacggaaagctcccgaagctcgagagcgataacgtcgatctcaacaagttggttgatatcgggaactccctcaaggatatttttgaggaattggtctacactaagaacaactacaacaagcttaattcgcttgtctcgatcaagaaacaatggctgaagatctacttcaaaaatgaattttattcaaacgggaagatccagaactactccctgagcaatttctcttacctgcccaacaaactcatcgagtggctgaacaactggcagaacaacctcaaggctctgatagagctgaccaaacagcaagatttcaacaagacgaagaagtcagaaatagcgtacatcctctcccttttcaatgggaagtattcctttagctttgttaaggatttctcaacgtgtatcaatcataagaactcgcaggagcagatcctgaaattgcagggcgttgtggagaatttcgagaaggtgctgaatctttgtattcaggagtacctccccagcaagagcgctggcgtcgtcattgcacagggctcgatgaattattacgcgatcaataaggaaccaaagaggtatgacaatatcctcgccgatcttaaccagaagttcgaagagctcgacaaggaatatatcgccatgaagcagtataagtcatcccagaagtcccggttgtttgaattcataagaaaggggttctccaaggaccagatcctttcggaatttaagaaaaaagaaaacaatgaagtgtcctttgtgtacaataatcagatcattattcgcatttacacacaagagttgttcaaggattcctactgtcttggagaagttatcaaattgacgaagaagattgaggagcttaacgagtcgaaggacagcaacaacaacctgccggaagaaacaaagaaggaaattactaagcttaagaaagagattgggttctactttattcgcaggacacgcggaaagagccataataactactttaagtcgtactacggtttctgcaacgacaagttcaaaaagaaagcacaggagaggggacggctcctcacaaagatcaaggctatcagaaaggagaaaattgagagccagaatcttagatactggagcctcatcctggacgacggcaaggacaagttcttgtggctggtgccgaaggaaaacatgcaggagtttaggagagaactctcaaaaattcacccttccggggagtcgtcattgtttcttttccattctctgacgatgagggccctccacaaactttgcttcgcccaggaatcggacttcgtgaaagaaatgccaaaggttctgaaggaggagcagctcaactgcgagaaggcatcgaacgatactgagactaacaagaggatcaagcgcaatttcggactgaactatataaaaactaaggacgaactgacactgtccttcctgaaaaagttgatcatttcagaatatgcgcacgaacgcctcgatctcaaccacttcgacctcagcaaactccaagtggcgaccactcttaatgagttcgaggaatacctggaagatgcctgctactacctcgaaaaaatatcaatttcttcgagcatgattaaagagcttctcgaggagtacaatattctcaacttcagaattacgagctacgatctggagaagcgcaacaaaaatacgtaccaaacacctgaatccgacattaaaaggcacacgaaggagatttggaacaaattttgggagggcgatagattcatccgcctgaaccccgagatcaaaatacggtacaggcaaaagaatcagaatattgaagactatctcaaggagaagggcttcgatttgacaaagattaaaaacaggttcctgcaggagcaatattcagtctccttcaccttcgctcttaatgcgggaaaaaaatacccgaaactggcatttgtgaagacagaagagatcctggagaaaatcgaggagtttaatgatgagttcaataaacagtacttcgataattcgtacaagtatggcatcgataggggcaacatagagctcgccaccctctgtataacaaaattcaacaagaacgatacgtacgaatacaaaggtaaaaaatacctcaagccaaatttcccgacttctcaggaagacataaaaacttacgagctgaagaatgagtggtacaagaggaccgctatttctaatatcgaaacgaagcctaagaataaaaaaacgcccaaaagaataatagctaacatttcatactttatagacaacgtggagaacgaagagtggttcaataaaaaaacttgcaccagcatcgatttgaccaccgccaaagtgattaagggcaagctgatactcaatggagacgtcttgaccttccttaagcttaaaaaggaggctgcaaagagaatactgttcgagctggtggctcagaacaaactgaccgcaaagaacaaggaactgaagtggaaatcagatgatggcaataacagcgattccgtcagactcatatgcgatgtgctcgacaatgagactaatagcatctacttttacgaggactcgaagtacgggaggggatttgagggattgttgacgactgataagacagcgtattctaaggaaggcatccgcattaacttgcagaactacctgaaccaccttatctctgagaaagaaaataagtctaacaaggcctactcccatgtcccgagcatcgagaagatcaaccacttgagggatgcgctggtggccaatatggtcggtgtcatctcttatctccaggcgtactaccctgggatcgtggttctcgaggatttgaaccacaaactgttgattaaacactttgaagatctgaacatcaacatctcaaaccgctttgaacacgccctgatcgagaaattccaaacgctcgggatggttcccccgcacattaaagattatctggagatacggtcatctttccggatgagcaggaacgattccagccagttcggcgctctgattttcgtttcaaaggaaggcacctcgaaagagtgtccgtactgcgagaaaaaatggaattggggtaaggaaaaggagattgagctcaagttttctaagaagcaatatatctgcggaaaagagaactcttgcgggttcgatacgaagcacatccaaaacacgtttgaattccttagcgagataaacgatcccgataagatagccgcgtataatattgcaaagcgcggattcaagtcattcattaacaagtcgagcattaaaaagcaatga

SEQ ID NO: 119 - DNA, 3129 bp, Unknown
  Metagenome-Derived Sequence
  misc_feature (1)..(3129): Unk10 Csm1 gene (plant codon-optimized)
atggccccaaagaagaaacggaaggttatggagaattccaacctgtaccaggtggtgaagacaatacgctttaagttggagcctgttggaaagatggacacaccgaagtttggggataaaaacgccgaatccaaggcaaacctcacccctttcattgagttggtcaagaagacaatgaccaatgtgaaggccctcgtgttctcgaagcaagatggggaggatggcgaaaagtggagaaagatactggaagtcaactacagatttctcagatcataccttaagaactcattctatgaaaatagaggggactcccaggaaaagagcaagaagcacaagatttccgatctcgagtacctgcagaaggcgctcgagaacttgttcgctgaatttgatgagatactcgacggcttggaggacttcgaaaaaaggaacacgaaaaatcagtacgaaaagcaaagacatgcacaggccggactgctcctcaatagattgtgtaagcgctccaacttcgggtttcttaaggctttcgtgggtgccctcgcgcagacaaacaagccgttctttgatgacaagaccgacaaactcaagaagcagatcgacaagtttgaaaccgagctcgagaagcagaaagagtttttcctgccttatcaatcgaacggggtccttttcgcgggcggttcgttcaatcggtacgctataaataagacccccaagatgctggacaaggagttgagagaagagcagaccaacttgaaaaaatcactctgcgaacacaagatcaagatcgatacccttaatacccttggactgaagaacgattgcccctgcacatccctggacaattcctacactttcatcaaagactataaggcaaagcagaagagcaagttcatcgagctcgtccagaagggagagtttgacgaggcgaagaaggtcaaccttttcgaatgttcggagacagacttcgagactttcaagactcgcacgaagcagatccagaatgagaaagataaagatgaacggacgaaactgaagcaaaaacggggtgagttctttaagtctcagaaaaggggcaagttcttcaaatctcaaactcaaaactatgaaaacctctgcgatctgtataagaagattgcgcagaagagagggcaaatcgttgcaaagatctgcgcaataaagaaagaaaaggaaatgtgtgagcaggttaaatattggtgtgtggccttggaaaaaggcggtgagttctacctgtatatgttcctgagggatgagaacgataatatcaagaatgcttatgactttgtcagcaaacttcaaactcagaaatccggcgagacgaagctccattactttgattcactgacattgaaagcagttaggaagttgtgttttaaggagaccgatgggtcttttaagaaagcgctgaagaacgtcaagttcccagaatgcgaacagaatcttgacgagaaagttaagatctcgttctaccaaaatgtccttaagaatgcgaagaccctcaatctctctaagtttgagaatcttcagtctgtcactgaaggaaagttcgagtccctctccgaattcgaggtggctctgaacatggtttgctatacaaagacggtgtgcgtttcggaatctgtggaaaaggagttgaaaaagttcaagcctctggtcttccacataacctctcaggacctggccgccaaacgcgagaagaaggcccacacacagatttggcatgaattctggagagagtctaacgaaaagtccaagtttccacttaggcttaaccctgaattgaaagtgatgtggcgcgaggcgagaccgtctcgggttgagaagtacgccgagcagtcagataagttcgacccaaataagaaaaatcggtaccttcaccctcaatttacactggccctcaatttcactcaaaatgctcataatgaggctataaacctcgcattcaaggacgttcagaataagggggaagccgtgaagaaattcaacgaaaacttcaagtcatctgaatatgctttcggaatagatgtcggtaccaaagacttggcactgctgtgcctcatcgacaagaataagaaacccgtcaacttcgacgtctacgagatttgcaatgaaaacgagatctgcaacgaaaagctcggatttgagaaatttggattttacaaggatggcacgcgcagggatgagccctataaattgattaagaatccgtcatacttccttaatgagtcgttgtacaagaagactttcaacgctacgaaggaggagttcgagcggtccttcagcgagctttttaagcggaagtcagtttgcgctctggatttgactacagccaaagttatatgcggaaagataatattgaatggggatttttccacccatttgaacttgaagatcctcaacgcaaagagaaagatctcggccaaacttaagaaagatccaaccttgaagattgagtatgacaacgatgacaacatactgttcggatctaatgtcattttctattacaataataagtatgagatagtgcgcccttacgacgagattaagaacgagatatttgagttccatgaaaagcaaaggttggatgatgcgaggcttgaggacaacattaataagactcgggcgaatctggtcgccaatatggtgggtgtcatatctttcttgcacaaggagttttcagggttcgttgtccttgagaatctgaagcaatcggagatagagggaaaccatcgcctgaagtttgagggggacatcacccgccccctggagctcgcgctgtatagaaaatttcaatctaaatgtctgaccccacccatttctgaactgatcaagctccgcgagggtgagaagaatgagaatgttgagagcgatttgatccttcaattcgggatcatcaagtttgttgataaggacaaaactagcagattgtgccccgcgtgtggtaaagatgcgtacgaaaacaacaattcgaagtataaaacagacaagaaggacggcgtttttgagtgtgcgggctgcggtttcaacaataaaaacaatgccggcgattttgcagcacttgatactaacgataagattgctaccttcaacatagcgaagcgcggcttgtag

SEQ ID NO: 120 - DNA, 3732 bp, Unknown
  Metagenome-Derived Sequence
  misc_feature (1)..(3732): Unk11 Csm1 gene (plant codon-optimized)
atggccccaaagaagaaacggaaggttatggagaagaatgagatagcaattagcgaataccaaacacagaagactattcgcttcggtctcaccgcgaccaatcagaacctctactccgaagaaatcatgaaactcctcgatatcagcgagaaacgggtggagaaacaagccgaacaggcaaagaaggtgaacaatgacgcggacaagaataatcaattgcgctgctgtcttgatcagatcaaggagtaccttaaaacgtggtctaatatatacccacagatagacttccttgctatcactaaggatttctacaaagtgatatctaagaaagcccggttcgactttgacaagggaaatggctcggagatcaagctgtcgtacctgcagtccacctattacaataagaagcggtacctctatataatcgaatcttggaaggagaacctcaggaagaccgagaatctttataggaagtccgacgacctccttaaagtcttcgaggaagccaaaaaccagaaccgggacgacaagaagctcaacaaggttgaattgcggaagacgttcctgtcgctctttaacctggtgaacgaatcacttaagccccttatcgagggtaatcttttcatcgttaatgatgacaagatcgacgagcaaaatcctaagcacgactgtgtgtcagtctttatatctaagactgaggagcgcaggaaactgtacgattacatctgcgatcttcaagattatttcaaagataacggaggttacgtgcccctcgggagagtcactctgaacaagtggactgctctgcagaaaagcaataacagagatgcagaaatcaatagaatcataaaggagttgaagatcaactctgttagcattcagaatattgaatacgagtacaacaattttgcaaataatttcaaggagaaaaaagatgaaaacggtaaaatcgtgaagaataacgcaggcaatatcatctgggatttgaaggccgacgctaagtcggtgatagagatctgccagttctttaagtacaagcaagtccccatcaatgcacggctcaacctcgcaaagcgcctcgagaaatctatcgacttcctctcagagtttggcgtctcgaagagccctgcgctggattataagaatgataaaaacaattttaacttgaccaattaccctctcaagatagcgttcgattacgcctgggagaattgtgcaaaggccaagcatgaggagattccattcccaaaggagcagtgtgaaaagtacctcaaggatgtcttcgatatcgatattgagtgcaaagagaaatgccaaaataaagagtgcaagggctgcgaaaaatgtagagggtactaccttaacaaatatgccgacctcattaggtttaagatccttctgggcaggttgaaggctgagttccacaagacagacgaagaaaaaaataagtcaaatattcaagagcttaggaatattttccgggaccttgattaccgcggcgataaacgccttaataagaacgagatacagaaggctgtgaacgcgtggttcgataataaagagcagagcattggtcgcaaaaaggaagacgagattcacctcatggagaacgaaaagaataagttctcgctctctatgcaaattattggacaggagcgcggcggcttgaaatctagaatatcgaaatataaggcccttactgagatgtttaaagtgtgcgcgagcaagttcgggaagcagttcgcagacctccgcgattactttaacgaggcgtacgaggtggataaaatcaaatatagagcttggatcatagaggacgagaagcaaaaccgcttcattttgttcgtgaacaaggaaaaagaagtcgatctcactagcgaggaaggggacctgtacttttatgaggtgaagagcctcacttcgaaaagcctcgtgaagttcatcaagaaccggggtgcctaccctgatttccataaaattaataatcggcagatcgacctgaattcgggagagaaagacagcaggggtaacttcattgacgatgtcaaaatacactggtccacgtacaaaaataaccagaaattcttggacaagctcaaggactgccttcaaaacagcacgatggcaacggtccagaaatggtcagagttcgagtttgagtttgatttctctaattgtgacacttatgagaagcttgagaaggagatcgaccgcaagggtcataagctcgagcggaagaccatctcactgacgacaatcaccaacttggtggaaaacacagcgtgccttctgctcccgatcgtgaaccaggatcttaataaaggaaacaaacaagcaaagaatcagaaccaatttacgaaggattggtttgacatctttgagaataagaagaggctccaccccgagttcaatatcttctatcgcttcaaaacgaaggactacccaaacaccaaattcaaaaatggtactgagaagacaaagaggtattcgaggttccagatgcttgcccattttggttgtgaggtgattcctcagggcgactacctcagcaagaaggagcagattgctatatttaacgatgataaaaagcagactgaagaagttaaaaagtataacaagaacatttcgtcggacgtcgactacgttattggtatcgacagggggataaaacagctcgcgacattgtgcgtgctcgacaaaaatggcgtgatacaaggcgggttccaactgtttacacgcacgttcaacagcgaaaccaaacagtgggaacaccaagagcttgaaaaacgcaatatactggatttgagcaatttgcgggtggagaccaccatcacaggtgagaaggttctcgtggatctcgcctccatccaaacaaaaaatggcgaaaaccgccagaagatcaagctgaaggaactggcatatatacgcgatctccaatataccatgcaaacacgcgcctctgatttgcttgacttcgcgtctaaaattaactcagcggatgatataacggaaaataatatcaaaaactttatttctccatataaagagggtgaaaagtatgcggatctcccacaaaaggagatgtttgacctcctcacggaatggaagaacgcagaggaggaaggcaagcgcaaaatcgctgagctggatcccgcggataatctcaaatcaggaatcgtggcgaacatggtgggtgtggttgcgcttctctgcgcgaaatacaagtatagggtgcggatagcgcttgaggatctgacaagggcgtacggtattcagaaggacgcactgtcgggcgcaacgatttttcaaaacgatgaggactttaaggagcaggagaacaggcggctggccggggtcgggacaatgcaattttttgaagtgcaactgctgaagaagattttcaaggtccaaattgataaggacctgcacctcattcccgctttcaggagcattgctaactacgagaaaattgtgagacgcgataagcaaaactctggtgatgagtttgttaattatccgtttgggatcgtctgctttgttgtccctaaatacacctccaagcggtgccctaagtgcgaaaaaaccaatgtgaacagaaaggagaatatcgttatatgtaaagaatgtgggttccagactaaagagggcaacccctacgaaaagaataatattcacttcataacagacggagaccagaacggagcctaccacattgcgaaaaaagcactctga

SEQ ID NO: 121 - DNA, 3519 bp, Unknown
  Metagenome-Derived Sequence
  misc_feature (1)..(3519): Unk42 Cms1 gene (plant codon-optimized)
atggcctcgatctgcacgtccgaaagccaggtcatcaacatggagaagtataaaatcaccaaagccatacggtttaagcttgaacccaaacaaatctcggaaataaagtctaacgtgaaggctatagaaagcgagaatgaatttaaccttgcgttgttcatttcatcccttagctcgtttctctccaagttctatgagtattttttctataagaataggaacgataagcttctcatcaatggccggattgcgataaaaaacagctggctcaagcagtatgctaagcaagaaatagctggcttggaacttaagcgcggacagaatataggtgatatcggggcactctcggataaaatacggaaagccagggacgaagttaatgacatctacatacagctgtgcgatgaaaccgcggagctcaatgaacgcgccaaccgcgtgaaaaaggggctgctcattaagaggctggcggcgcggaacgcgctcccccttctgatctcactgattgaaaatagcaacgacaagaacgaaacgggcaacctttctgtggagctgaagcagcttggtagcaagctggaatcgcaaccagtgtcgggtatcaaaatgtatttgccgactcagagcggcggcataccgatcactaaggcgtcgttcaattattacacgatcaataagaagcaaattgactacgggaagaagaagcaggaccaaattaatttgcttaagatagatctcaatgatttcgaagattctaatctgaaaaaagcgagcttcgtgaagaatctgaagaaaagaattgttcttgatattagcactcgcaaagaacttctcgaggaaaagttctcgaagtccgagtctgcgtgggctgcacccctcgttgagttcgactatgtctcactccgccaaatactcaagaatattaagtcctaccagatcaaaaggttctccgagtttatgcagcgcgaggattctacctttatgaatctcaaagagaatgatgagctttacctgttcaatgacattactgaggaggagttcaatgaatataagcaaaagaccaaggatattgagaagaaggcagagaaaaagaaccagtgcaacaacgacgaactcaagaaaaagctgaactccgagcttcagaacttgaaaaaagaacgcggttcgcttataaacgcggcagacaagaagaccaattcaaagttcaagacgtacaagaaattcgtgaatatttataggaatgtcgcacagaagcacggccggattttgtccaagcttaagggcattgagaaagaacaggtggaatctcaattgcttaagtactgggccgtcatactggaggaatctggccagcacaatttggttcttatcagcaaggagaacgcgggcgaattcaagaaatggctggaaaataataagtcaaaagagccgacgtctccgatcaaaacttactggctggaatccctgacgctgcgctcactcagaaagctgtgtttcggatatgtcgagaacaagacacatagcaataccttctaccctgagattaagaagtcccctcagttgcagaaatacaagaactaccgcggagattttatcaagggggagtttgacttcaaaggcgacgagcaaaaaacaatcaacttttacaaggatgtccttcgcacagactacgctaatggagtcctgtctttcccaaaacagcaggttaaagacaaaatcctggagaagaagtttagcacgctcgatgaattccagatcgcactggaaaaggtgtgctacagacgctttgtgctgtgctcatcagacatcaagctgaaactcatagaatatggtgcagagatcttcgaaattaccagcctggatctgtccaatcctaacaaaaaaaacataaaaaaccacacactcatctggaagacgttctggaacactaagaatgagtcaaagaacttcgaaattagactcaatcctgagatcacaatcacatatcggtccccgaagccgtcgcgggaagaaaaatatggacgcaatagcaccctttatgatgaaagaaagaagaaccgctacttgtacccacaatacacacttatcacgacgatcagcgagaatagcaatgcaccgacgaagatcatgagctttatgatagacgatgagttcaaggctagcgtggatgcgttcaataaaaagcttaagaaagaagatgtgaaattctcccttgggatagataatggcgaggcagaacttagcaccctcggggtgtacctcccagcgttcaaagataaaaacgagtttaaaaacatcaataaacacggcttcaaagtgctgaccatgaaggacttgagctactctgagatagataccaatgagaaggaacgcaagataatacaaaacccatcttacttcctgaataaagaactctacatccggacattcggcaagacggaaaatgactacaataaaatgttcgaggaacagttcgaagagaagaccctcttgtcgatcgacctcacaaccgccaaagtcattaacgggcatattgtcacaaatggagatgtgccgaccttcttcaatctctggatgcgccatgcacagaggaacgtttgggatatgaacgatcactcgaagaacaagaccgccaagaaaattaccattaagaacaatgacgaacttacagagactgaaaagacaaagtttgccgagtatatatcagacgagaagaagtataagaagctcaaggacgaagaaaaatcaaagtatctcaagtggatctttgaggataggaagacgcttaagttcacggaggaggagaaggacaagttcgagaaatgcaagaagagaaaggacaacttcacggaaaatatacttttcgctgtctgccagattggcaaagacatccagagcgtcaccgatgtgttcgacgtccggcacattttcaagaagagggaaaacttcgatgcgctgaagccagaagaagagattaagaaggaaatcgagagctacaattcgtctgaatcaatccaaaagatatctaatgaagaactcgacctcaagatcaatcatctgaagcaaagcgtcgtggcgaacgccgtgggcgtcataaacttcctctacaattactacaaagagacgacaggcggcgaaggcctgatcgtcaaagagggcttcgacacaaaaaaggtcgccgatggcctcgagaagttctcgggaaacatttaccgcatcttggaacgcaagctgtaccagaagttccagaactacggtcttgtccctccaataaagtctctgatggctgttagggaggaaggtattaaagacaacgatattgacaagacgattcgcctcggtaacgtctgcttcgtctcccagtctaagacttctaacatctgtccaaaatgcaactcgaataagcttaagcacggcgatatatgctcgaattgctcattcaacctgataaagatttttcattcaaatgatggtgtcgcgggatacaatatcgccaaaaggggcttcgagaattttaataac

SEQ ID NO: 122 - DNA, 2721 bp, Unknown
  Metagenome-Derived Sequence
  misc_feature (1)..(2721): Unk14 Csm1 gene (plant codon-optimized)
atggaaaaaaattataagagcgagattaacctctcgtacgaggacattctgaacaagttcaatctcctcggtagagccattgatatcgcaaacgacttcaagaactcaaacaatcagaacaacttctcgcttgatgagtacccgatcaagctggcgttcgattatgcttgggagaatactgcccgctctcttaaacgcacaattcctttccctaaggaagtgtgcaaacagttcctcaaagataacttcgacgttgacatagataatgccgacttcaagctttatgctaatctgctttttattgcagacaatctggctacaatcgagtacaacaatcctaacaatgaggttgaactgattaatgaaataaaacaagcgtttgaatgtatttcctttccatttgacaaagaggtttacaagggccataaagaggctatattggaactgctcgacaaggagaagtcccaaagggactactcgacaatcctcaaggccaagcaagaattggggttgctgaggggggggctgaaaaataagatcaaaaagtatcgcgacttgacacaaaggctcatcgacaaaaagaactctcatttcggcattgcgtcctttgtgggaaagacccttgcgaccatcagggatggtttgaaagaagagaatgaactcaacaagatttcggattacggggtgattattgaggacagcaatcaggacaaatacctcctcacattggagctgaatgggaaggatatcagggacaggattagaaattcgctgggcaatggcgagtataaaacttacgaagttaactcgttcacaagcaaggctctgaataagttcatcaagaatccattgtcagaggatgcaaagaagttccatggaaagtacaaagacgagtattcattcggttacgagaacaaagacggtgacttcacctacaagattactaaggtgtcgaagtatgacgagcaaggcaagtggactgggtaccaggagtcattccttagccacattaagaaatgcctgatcgacagcgagatatctagagagcaaaattgggaggcgttcggttggaattttgcgggctgcaatacctatgaggagatcgaaaaagaggtggattctaagggttaccagctgacggaaaatctcatatccatgggcaaccttaaatctctggtcaaggatgagggctgcttgcttttccccattattaatcaagatatctcaagccagaagcaagagaataaaaatatcttcacattggatctcgagaaggtcttcgaaggcaaggagtgccgcattcacccggagttttccatcttttatcgccggcccattgaggagcacaaaaaagagaataagtcaggaataattaaccggtttggccggctccagttgttggccaatctcggcatcgaattcgtgccgagaaacccatcgttcaagaccaaaaaggaacagaacaggattgccattgaccagaagaaacagaatcaactggtgcaggaattcaaccagaagaaggtcaacacctatttcgagggattggataactactacatatttggcatcgaccggggtatcaagcaactggcaacgctctgcgtcacggataaggatggcgtgatccaggactttgacatatacactaagcacttcaattcggaatctaagaagtgggagtacaaattccatcggaaggacggaatcttggatctcaccaatctgaagattgagtcagatcgctctgggaataagtatatcgtcgacatttcactgttccaggcaaaggacgaggacggtaacccgacggggacaaacaaacaaaatatccaactcaaacagttggcgtacatccggaaactccaatatcagatgagcgcgaacgaggagggggtcttgaatttcctcggtaaatataagaataaggaggagagagagcaaaatatggaggaactcatcacaccgtataaagaggggaaaaacttcgccgacctgccgatggatatattccaggaaatgttcgaaaactactatcggctgaagacggatcaaaacctctcagagtctgaaaagaagaacttgatgaagataacgaccgaacttgacgcctctgagtctctgaaaaagggagtggtcgccaacatgataggcgtgatatactacctgatgaaaaaatatgagtataaggttaagattagccttgagaatctctcaaatgcgtggctcttctcaaaggatgggctgagcggcgacgttgtgctcaacactaagaacgacgagaccatggacctgaagaagcaggataacctcgcacttgctggcgtggggacatatcactttttcgagatgcagctgctgaataagctcttcaagatctcgacggaggaaggggtcctccaccttgttccatctttcgggagcgtcaagaattatatcgagattatgaagattaaaggtaagtacgtttataagcaattcgggatcgtgtattttgttgatcccaggaacacctcgaagaagtgcccagtgtgcggtaagggaggaaagaaatacatttccagggtggacaatgtcgtgacatgcaagaactgcggatttgacacttcctcggataattcaattctgataaataattacaagaagcagggtaagaatatccattttattaaaaatggtgacgataatgccgcatataacattggcgaaaagatccgctga

SEQ ID NO: 123 - DNA, 2757 bp, Unknown
  Metagenome-Derived Sequence
  misc_feature (1)..(2757): Unk15 Csm1 gene (plant codon-optimized)
atgattgagccagggaattacgtgtacctgcgccagattctcaagaacatcaagctggaacagaaaaataaattctccaagctgatgcaatcaaagtcattgactttccatgatcttaacaacaacaatcagctgtacctcttcaaggacatactcgagggggagttcaacaagtacaaacagaaaacaaacgagatagaaaccaaagctgaaaaacggaatcaatgcaataatgatgagctgaagagaaagctgaactctgagctgcagcagcttaggaaagaccgcggcagcctgatcaacgccgccgacggacggcccaaaggcagatttaaaacgtataagtatttcgctaacttctacagaaatgtcgctcagaagcatggccggatcctgagcacccttaagggaatcgaaaaggagatggtggaatcacagctgcttaagtactggactatcattaccgaagaaaataaccagcactccctggtgctcattccaaaggaacgcgctggcgagtacaagaaggatctggagaattcaattccatcggatcccagctctaagattaaagtttattggttcgagagctttacgcttcggtccctgagaaaactctgcttcgggtacgtcaacaacaacaccggtagcaacacgttttacccagagttgaagaaatctgatgagctgaggaaatatcatgacgagagagggaactttattaaaggtgagttctatttcaaaggtgatgaacaaaaaattatccaattttataaggacgtcttgagatctaactacgcacagaaggtcctcaagttcccaaaacaacaagtcaaggacgaattgatcggtcgcgaatttagctctcttgatgaatttcagatcgctctcgagaagatctgctaccaaagacatgtggtctgctcccaaaaagtggtggacgctttgtctaggtataatgcacagatctttctcatcacctccctcgacctcgggaacccagcgaactgcgtggacaagccaaagcaattctcccacttcgataagaaacatactaggatctggaaggagttctggtcgagcaaaaacgagacagcgaacttcgatataaggctgaacccggagatagtcattacctataggcagcccaaacagagcaggataaagaagtatggcccggaatctacacgctatgacgatcgcaagcataataggtacctgtacccccagttcacgcttatcacgactatttctgaatactcaaatgctccgaccaaggccctctcattccttaccgatgaagaattcaaaggcgctgtggacgagttcaacaagaaattcaaaaaggagaatatccggttctccctcggaattgataatggtgagactgaactttcaacactcggtgtctatctcccggtgttcaaaaaggattcgaacgagaaggtggttgcggagctgaagaaggttaataaatacggctttaattttctgactattaaggacttgtcccacgtcgaaaaggataaaaacgggagagttcgcaagatcatccagaacccatcctatttcctgtctaaagaacaatacatgcgcactttcggccggacggagcaggaatacaacaatatgttcgccgagcagttcgaggaaaaggcgttcctttcgctggacttgacaacggctaaagtgataaatggccatattgtgacaaatggcgatgtgcccaccttccttaacctgtggatgcgccacgcgcagcgcgatatctgggacatgaatgatcacacgaaggaaaaaacggctaagaaaatagtcataaagaacaacgatgagctcaccgatgctgagaaggtgaagttcgttgaatatatctcagacgagacgaattacgcgaagctcaatttcaacgagaagaagcggtacgtgttgtggattttcgaaaatcggaaaaacataaatttcaccgatgcggagaaaaagaagttcgaaccgtgccaaaaaaggaagggcaattttagcaaagacattctgttcgcggtctgttatattggcagcgagatccactctgttaccaacatctttgatgtgagaaacatattcaaaatgcggaaggatttctatgttctcaagtctgagatggaaattaaaaaggagattgagagctataacacgacggcgggcattcaggagatctccaatgaagagctggacctcaagattaatcgcttgaagcaagcggtcgtggccaatgccgtgggggttatcgactacctgtatatatattacaagaagaagacggggggagaggggctcataataaaagagggctttgacacaaagaaagtcgcaaaggccttggaaaaattcagcggcaatatataccgcatactggagaggaaactgtatcagaagttccagaattatgggttggtgccccctattaagagcttgatggccgtccgggaggaaggaatagagaataataaggacgcgatcttgcgccttggcaacgtgggattcatagacccgactggtacttctcaacagtgcccggtttgctctaagggcaagctcaatcacaccaccaagtgctccaaaaactgtggattcaactccaaaaatataatgcactctaacgacggcattgctggttacaatatcgctaaacgcggtttcgagaattttatatcgcagaagaagggttacgatgtcatcaacaacggtactaaatacaacaaccttaagagccagtga

SEQ ID NO: 124 - DNA, 3036 bp, Unknown
  Metagenome-Derived Sequence
  misc_feature (1)..(3036): Unk16 Csm1 gene (plant codon-optimized)
atggactaccagcagtacgagttcaccagaaccattagatttaacctttcaggtgatgataaacgggcactgatgttggacctgttggacgatactcaggaaggtatgttggcagcattccaggaaacttacaaaaatctgctgttcgcgttccaggaagccattctccgcgccgatgggtccggcaatcttcgcgtcggccgcctggaaattaaaaaatcttggttgagacaatatgcccgggagtatttctacgcactgtcagaagacgaacgcaggtgcaaaaacaagttccaggctaagctctttgatagagttctgtcagattggcttgagcggaacaacgagctgctccagagactgaataatatcctgagcctgcctcaagaatccaagaccggagccagcgatctgtcgctccttgtcagacaactgaaaggagccgagtatttttatttcatcagggacttcacccaaagcgggattatcaatgataaggattcggacgagcacattaagaatttggctgggatagtggagaagttcgagactctcctcgataaggttttgttcctcacggcgccgaattcgtcccagggggtggaaactactcgcgccagcttcaactactacacagttaacaagatttccaaaaactttgacgagaacattaaaaaggccaacgggagattgtgcagctcttaccagaattcaatgaacgaggagctcttgcggaaggtcggttttctgaagtatcttaaggacgagtatagggccgagcttcagaatgtctcactcaaggacctgtacgaagcgttgaagaagttcaaatcccaacagaaaaccgctttcattcaagcggtgcaaaaaaacaaatctgaaaaggagctcatgagggagtttcccctgttcaatggtaaacagccggatacactgcaaaaatttatattggagaccgataagatcaagagaggagcctactttcagaaatggggctttgacaactacatctcattctgtaacaagatattcaagcccgtcgcaatggagaccgggacccgcaaagctaagatcagagccctcgaacaggaaaaaattgaagcaaggctgcttcaatactgggcgcacatcttggtcaaggacggcaagtactttctcctccttatccctaaggagaagatgggcgaagcaaaagtctttttcgctcgcctttcagatcaagagggcggtgagtacaccctgtacgcgtttaactccctcacattgagggcgcttaaaaagttgatccggaggaaccttggtaaagagcaggttcgcctctccgcaggcgatgccgacgccattgcactgtgccaggaggtgcttcgcggcagataccatcagctgaaggatcttgatctttctggattcgagaaagagatcgcagaaatcgcgaacacccagtatgagaatgaggaagagttcaggatcgctctcgagcaggtggcttactacctgtcagaacggaagatgaacgaggagtccatagagtaccttaagaagaaccttggtgctatcctcctggagatctctagctacgacctggaacgcaatataacgggcgagtcaaaggaacacaccagactttggagcgatttctggaacccgaacaacaagaaagaatgtttctcaacccgcttgaatcctgagcttcggatcttctatcgcccaccacgggaacaaaaagaccctaaaaaacagaagaatagattctcaaaagaccaccttgccgtcgctttcacaatcgcccagaacgcagctcggaagaggatggaaaccagcttcgctgaggagaaggaccttgttgaacaggtcaagaagttcaatgaagaggtcgtcgggaagtttattgatgagaaatcagataacctttattattatggcattgaccgcggccagcaggagctggccacactttgcgtcgtgcggttttcgaaagagcactacgaggcgatgctggaggacaatttcattaaaaagttctccaaacccatcccggcgcagatcaccgcatatcgcattaaagacgaacacatgtcctaccggaagaacatcactagagatcttaaaggcaatgaaacggaggagatcctttttaagaatccgtcgcacttcatcgacgaggtcgagaatttcgaggaggtttcgaccccttgtatagatctcactacagcaaaactcatcaaaggtaagatcattttgaacggagacatccagacctaccttgcgcttaagaaagcgaatggtaagcggcagcttttcgagaaatttgctaagatcgatgattcagccaaaatagaattcgatgatagcgagggcagattccaggtgaagtcaaaggctacggaacgcgaagagtatcagttcctgccatactacgggccggaacaagaaaacatttccccgcgggaagatatgagacgcgagcttcaggcctacctcgacaaactcaggagctcagaatccttcgaagaggacatctctatcgagaagatcaaccacctcagagatgcgatcacgtccaatatggtcggcattatcgcgtttctcttcacagagtatcccgggatcattaatctcgagaacttgcactctcgcgagaatattgaaaaaaactggaggaagaataacgaagacatctcgaggcggttggagtggggcttgtataaaaagttccagaagatcggcctggttccacccaggttgaggcagactgtcttgctgcgcgaaaatgagactgaacgccaggagaaactgaatcaattcggaataattcattttattccgacagagaaaactagcgctcggtgcccttactgtggagagaatacccctatgaagcagcggaacgaagataagttcaagctgcacgcgtatatctgccgctccaacgaggagaactgcggatttgacacaagggagccaaagtcccccctcgagttcatcaagaattcggatgacgtggcagcgtataatattgctaaaaagaggctttga

SEQ ID NO: 125 - DNA, 3090 bp, Unknown
  Metagenome-Derived Sequence
  misc_feature (1)..(3090): Unk17 Csm1 gene (plant codon-optimized)
atgcggaagatgttcttgtcacttgcgaatattgtgtgtgaggtccttgttcctctctgcaacggcagcatatgcttcccagatatagaaaagatgtcagacaaggatgagaataagtacctgcgggagtttgccgtggattataagacaaagattgatctgttcgatagcatttcagaattgagaaagtacttcgaagaaaatggagggaatgtgccgttctgcagagcgacgctcaatcccaagactaagattaaaaacccatcaagcactgataattcaatagaggcggagatcgagaagattggaatggagaagtaccttcagacgaccgacgaaatcatcactgcgatcaataagatcaagcaaatgcaggacagcaagcttcctttgattaagcgcgctctcctcttcaagtacaagacgattcccgcggtggtgcagttcgatcttgctaagagcataggcaaaaagctcaacaaggaggaacaggagcttcgcactatcatacgcactatagggcaaacagcgtcgcctgccaaagattacgccgacctgcagcataagaaggagttcaacattaatcagtatccgcttaaaccggcgtttgactacgcttgggagtctctcgcgaaagcagaatatcataacgacatagaattccccaaccagatatgcaaacaattcttgaaggatatcttcaatgttgatactgaaactgacagctactttaagctgtatgcacagttcctgtatcttagagagctgttggcaactttggagcattcgcagcccactaatcctgaaaaaatcgtcaagataatagaggagctgttggaaaagattaacgcttggaaggaaatagacgataagaactccgagaagtacaaaaccgcaatctcgaactggctcaaaacgttcaacaaggaagacaacaactttaagaatgcgaagcaaaagatcgggctgttccgcggtggcctcaagaaaaaagccggtgataagtccagatgggagtatctgcgcaagccggatgaaaaagaagcgccgaagttgacagcgtataatgccctgactcaaatttacaaggacatcgccacgaacctgggtcggaacctcgccgatatgagggataagattaccaacgaatctgaactgaataagatttctcactacgcggccatcatagaagataagaacggcgataaatacgttcttctcaagaagagcgacaaggatgaggagtttgccctcccgtgtgagaaagacgccgagtacaagacgtatattgtgaactcaattacctcatccgccatcgcgaagatgattcggaaaaagagagctgccgaccttgcaaagaatatcaggttgaagtctgaggagctgaatgacgagcaaaaagaagccaagaacctcaaagactggatagagctgatcaagaagcaacagtacgactttgagttcaacctgaaccttaataataagaatttcgagcagattaagaaagagattgatgccaagtgctaccaactccagaagggcaatatctcaaagcagaccttggagaagctgatcaatgagcagaaggagtggctcctccttccgattattaatcaagaccttgctaaacgcgacaaatcaacaacaaaccagttctctaaggactggcagaagattttctcggataaaagatgcgggtataggctgacacccgagttcaggatctcctatcgcaagccaaccccaaattacccacaatcccaaataggagataagaggtattctcgcttccagatgatcgcgcatttcctctgtgattacattccccaggggaatctggagtataagtcgacgaggcagcaaattgagatattcaaagattatgagaaacaagaagaatcagtcaggaactttacatacaagatttacgctaataacgattatctcattttcggcatagataggggcctgaagcagcttgcaacgctgtgcgttcttaataaggaaggtaagatttatggtggctttgatatttatacgaggtcttttaacaaggataagaagcagtgggagcattcgctgtctgagaagaggaacattcttgatctgtcagacctgcgcgtggagaaaacaattacgggcgagaaagtgcttgtcgacctcaactccattaaggtcaaaggaaaccaagataaccaacaaaaaatcaagctcaaggaacttgcatacatacgcaagctgcagtttaagatgcaaaccgaacacggtaccgtgatcaatttcatcaataaatacaggaccccagaagagattcaaaagaacatacatgagctgattacaccatataaggaaggagagcattacgccgatttgcccacggaaaagatctgcaatatgttgcaaaagttcaaagagttctctgataagaacgacggtaagtctaaacgcgagctcatcgagctggactccgccggcgagctcaagaacgggatcgtggctaacatggttggcgttgttgcctacctgctcgagaagtacaagtacaacgtctacataagcctggaagatttgacgcgcgcgtataggagacagacggacggactcgacggtagagagttgttttcctccaatgatgacaagagcgttgacttcaaagaccaagaaaatactgcactggcgggattgggaacctaccatttcttcgagattcagctcttgagaaagctttttcggatccaacaggaggatggaaatattctgcacctcgttcccgcatttcgcagcgtggacgattacgagaaaatcattcgccgcgacaagaagatcgacggcaatgagtacgttgattatcctttcgggatcgtccggtttgtggatccaaaaaacacttcgaaaagatgccctctgtgttcgagcatcaatatcaacaggcataagaacattatcaagtgccaacagaaagcatgtggcttcaagaccccgtgggataagacgaacgataagaacatccaatacatccaaaatggcgacgagaatggggcctaccatatagcgaaaaagactttggacaatttgaacaacaagaaatga

SEQ ID NO: 126 - DNA, 3243 bp, Unknown
  Metagenome-Derived Sequence
  misc_feature (1)..(3243): Unk18 Csm1 gene (plant codon-optimized)
atggataggtttaagaatctttacgaagtgaagaagaccgtgaggttcgagctcaaaccctccaggaagaagatctttgagggcggagacgttattaagctgcttaaggatttcaagaaggtgcagcgcttgttccttgagatcttcgtctacaaaaagaaagacagcaagctggaattcaagaaaaagagagagattaaatatacttggctccgcacacatacaaaaaatgaattctataactggtcacgccggtcggatatcgagaaaaactacgttttgtcaaagatagacttcctccccgaagaaatcttgcggtggcttgatgagtggcagaagcttactgagtcactcgaggacattacacagactgaggagcacaagcagaagcgcaaatcgaatatagcttttgcgctgcgcaagttctcaaaaagacaaaacctgccattcatcaaagacttctttaatgcggtgatcgatattcaaggtaagcaaggcaatgaatctgatgttaggataaaggagttccgcggcaggctgaaagaaatcgagaaaaacttcaacgcctgcagcaagaagtacctccccacccagagcaatggtgttcttctccacaaggcatcctttaattactataccctcaacaagacccctaaggagtacgaggatctcaagaaagagaaagagctcgagctgaatggagtcctctcctgggccatttacaaacgggaacgggtcatcgataggagaaccgagcagactgaaattctgttcgactgtgatatcgactggttgaagaagattggtcttggggacgaaattcaaaactgggtgctggatgaggcgtatcagaagatgaagatctggaaggcgaaccagaagtcggacttcattgaagcggtggcacgggacaaactcacgtttcagaattttcgcaagaagttcccactgttcgatgcgtctgacgagaacttcgaaatctgctataaacttaccaaagaactcgataagaaaccaaaggatgcaaagaaggtcgctcaagagagaggaaagtttttcaacgcccccaaagagaagatccaaactaaaaactatttcgaattgtgcgagctttataaacggatagcgctgaagaggggaaaaatcatcgcagagatcaaggggatcgagaacgaggaggtccaatcccagttgctgacacattatgctatggtggccgaggaggagaataaaaagtttatcgtgttcattcccaggaagaatggcgaggagcttgagaaccataagaatgcccataagtttctgcagggcaaggagaagaaggaatccggtgacgtgaaggtttaccacttcaagtctctgaccctgagggccctggagaagctgtgcttcaagaaaaccaagaacacctttgccccagagatcgagaaggagacgaacccgaaaatctggttcccgaaatataagcagcagtggaacaaaacgccggagaagctgattgagttttacaaaaaggttctgcagtctgattactccaaaaaatacttggatttggtcgatttcgggaacctgaatacatttctcaaaacagacttcacaacgcttgaagaatttgagagcgtgctggaaaaaacctgttatactaaagttccagtctacttctctaagaaggaatttgaaacgtttaaggatgagtttgaggcggaggtttttgaaattacaaccagaagcgtctctactggttcagctcggaaggaaaatgctcacgcaaagatctggaaagacttttggtcgaggaagaacgagactgctggccatacgataagactcaatcccgaagtctcgattttctaccgggacgagataaaggagatgtccaatgcgtcacggcagaaccgcaccagcgacgtgaataatagattctcagatccgcgctttacactcgctactacgataaccactcacgccgacaaaaagaagccaaacctcgcattcaaaaagatcgaggatatcaagaaccacattgactctttcaacaccgtctttaatcgcgacttctctggggtgtgggtctacggtattgaccggggattgaaggaacttgcaactctgaacgtggttaagttcagcgatgttaagaataagtttggggtgctccagcccaaagagttcgcgaagatctctatctataaactttctgacgagaaagctatcctcaaggacgttggcggaaagtcactcaaaaacgctaaaggtgaggacaggaaggtgatagacaatatatcagaggtgctcgaagaaggtaaagagccagaccctatcttgtttgaaaaccgcattgttagctcgatagatctcactcaggctaagctgatcaaagggcacattatcacaaatggagaccagaaaacctaccttaagctgaaggagacatccgcaaagcggcgcatcttcgagcttttctctaacgctcagattgataagaacaccacgatttcaggcaacaagacaatcatgcttggcaagaacaacactatatactggctgtgcgagtggcagaggcaaaacccctggcgggacaagaaagagagcctcatgcagtcactgaaggattatctccagaacctggatatcaaaaatcattttaaagacattgagactatagagcaaatcaatcatttgagagactcaatcactgccaacatggtgggtctgctttttcacctccagaataagttgaagatacatggcgtgattgcactcgagaatctggatacggtgcagaagaagtctgattccaagatgatagacgagcatttcgagcagagcaatgaggacatctcgagacggctggagtgggctttgtaccggaaattcgccaacacgggcgaggtcccaccgcagattaaagagtcaatattcctgagaggcgagtttaaagtttgccagatgggcatcctgaaattcgtggaggttggagggacctcgagaggctgtcctaactgccagtctgagtggaaccaggaatgcgggaaccagtgcaatcccaagtgtaacaagtgcaccgaaaatgactcctacaagaaaaataagaggaagaatgtctacatttgcaaagacgacaatcaatgcaagttctcgaccgaagagtccagaaacctcctggagcagaatctgcacaatagcgatgatgttgctgcctataacatcgccaagcggggcctggagatcaatagcatttga

SEQ ID NO: 127 - DNA, 3258 bp, Unknown
  Metagenome-Derived Sequence
  misc_feature (1)..(3258): Unk19 Csm1 gene (plant codon-optimized)
atggagaagtacaagatcactaagacgataagattcaagctgcttccagataaaatccaagatatctccaggcaggtcgccgtcctgcagaactcgacaaatgctgaaaagaaaaataaccttttgcggctgatccaaagaggccaggagttgccgaagcttctcaacgagtacatcagatactccgacaatcataaactgaagagcaacgtgacagtgcatttccgctggctgcgcctgttcactaaagacctgttctataactggaagaaagacaataccgaaaagaaaatcaagatttccgacgtggactacctcagcagagttttcgaggatttcttcaatgagtgggagaccgttatcgagcgcatcaacaccgattgcaaccgccctgaagagtcaaaaacgcgcgacgctgagattgcttttagcattaagaagatcgctactaagcagatgttcccatttatcaagtcttttgtctacaattcaaattataagaactcggaggaaacaaaaagcaagctgactgcccttctcaatgagttcgagacagtgcttaagatatgtgagcagaattatctcccgtcgcaatctgccggcatagtcatcgccaaggcatcatttaactattataccattaacaagaaacagaaagactataagggctacactgatgatatcgagaagattgagaagggcatgaactcaaagttccactatgagaggaaatacgaccaactgttggaagagctcaacctcatcgccctcaaggaactcccactcatcgagttttactccaagattaagtcttacaaaagcacccgcaaaattgagttctctgaagccgtgtccaaggggcttgccttcgccgacttgaagagcaagttccctctgttccaaaccgagtcaaacaaatatgcagagttcctcgagctcaccggccggatcacgcagatctcaacagccaaatccctcctgagcaaagataacccggaggcgcaaaaacttcgcgatgagataaagaaactgcgcatcaacaggggcgagtactttaaaaacaatttccataaatacatttccctttgtaacctttacaagaagattgccgataaaaaagggaggctgaagggccaggtcaaaggaatagagaatgagaggatcgattcacagcgcatccagcattgggcactggtcctcgaagataatttgaagcattcactcattctgatcccgaaagagaaggtcaccgaagtgtacagaaaggtgcgcgcctcgaaagccgactccacctcctcttcctcctctctgtactactttgaatctatgacatatagagctctccataagctctgtttcggcgtcaacggcaacacttttcttccggagatccagaaagagcttccagagtacaatcctaacaaacagtcggacttcggagaattttgcttccacaagtcgaataccgataaggagatcgacgagccgaaattgatttcgttctaccaatccgtgcttaagacaaattacgtcaaggataacctgaatctcccccaaagcgttttcgatgaggccactgtccagactttcgagacaaggcaggatttccagatcgcactggagaagtgctgctacgccaagaagacgatcatttctgagaccctcaagaaggaaatactggaggacaataacgttcaaatattccagatcacgtccctggacctccaacgctcagagcaaaagaatcttaaagcacatacaaagatatggaaccggttctggacaaagcagaacgaaaccgctaattacgaccttcgcctcaatccagaaacggcgattgtctggcggaagccgaagaaaacccgcatcgacaaatacggtgcagggacatcgctttacgatccgaaaaaaaggaatcgctatctccacgagcagtacacgttgtgtaccacggtcaccgataatgcgctgaacaatgagatcactttcgccttcgaggatacgaagaaaaagggcacggaaatagttaagtacaacgagaaaatcaaccagaccctgaagaaggagtttaataaaaatcagctctggttctacggtatcgacgcgggtgagatcgaacttgcgaccctggctctcatgaataaggacaaggaaccccaactcttcactgtgtacgagcttaagaaatctgactttttcaaacatgggtatatctacaataaagagagggagttggttatcagggaaaagccctacaaagcgatccagaatctgtcgtactttctgaatgaagagctgtatgaaaagacctttcgcgacggaaagtttcaagagactttcaacgagctcttcaaggagaagcacgttagcgcgatagaccttacaacagcaaaagtgattaacggcaaaatcattcttaacggagatatgattacttttctcaaccttaggattctccacgcgaagcgcaagatctacgaagagctgatcattaatccgcaggccgaactcaaggaaaatgagaaggagtattatctttacttcgataaagaaggtaccgagaaggttgaaaagatctatcggagccgcctcgattttgaacacattaagccctatcaagagatccgcaacgatttgaacgcctacttcaaaaatgtccagaagaatgaggctaaggtggaggatcagatcaaccagacgaggcgcgcactggtgggtaacatgattggcgtgatttattacctttaccaaaagtatcgcgggattattagcatcgaagatctcaagcagactaaggtggaaagcgataggaacaagttcgagggtaatatagaacggccactcgaatgggcgctttatcgcaagttccagcaggaagggtacgtcccgcctatttctgaactcatcaagctcagggaactggagaaattccccctcaaggatgtcaagcagcccaagtatgagaacattcaacagttcggaataatcaagtttgtgtcaccggaagaaacgtccaccacctgcccatcgtgcgaaaagaaagcttacgagttgcaaaaggaaaagaaaggcgaggagaagccagccgaaaataaacgctacgaggctgacaaaaaggctggcgtcttctgttgtcccaagtgcggcttccataaccggacgaacccgatgggttacgaatccctggattcaaacgacaaggtcgcagcctttaatattgcgaagcggggtttcgaggatcttcaaaaacataagtaa

SEQ ID NO: 128 - DNA, 3264 bp, Unknown
  Metagenome-Derived Sequence
  misc_feature (1)..(3264): Unk20 Csm1 gene (plant codon-optimized)
atggattccattaagaaggacccaaaagaagcaatgccgcgctttgagacggtgcgcactgtcaggtttgagctgaagccatcggcggacacgcttgagaagcttaaggcagtgctccctcgcggggacttccaagtggatatcgagaagttcatcaccggtttgcgcaagttctacagcgggctcgcagacattataatcgataagtcggaagagggctttgcgctccgccgcgggattgaaatcaaatacgggtggctccggtcatacactaagaacgatttctataccttcattgagggcggcgatggacgcctcccgatcaaatacggcatatccgacgtgggttatctcaagagagaacttcagagatggttcgtggagtggaaagagataattctggaattggaaggcatgatccaagcacctctggagtctcagaggaggaggcgggatttcgcccagctgattaggggattgaaaaaaaggcagaacttcgaattcattagagagttctccaaagcactgtgcaataccaacgacccagccacagatcacttgatcgaggatctcaggataagcattaactcccttgagggtgaattgcaagaggtcgaagccgcttttgcctcctcgcagtccgccgggtttcagatagcaagagggtctttcaattactatacgatcaataaggaccctaagtccctgaagacagaagagaaagaggaaagagataagctgaacagatcgctctcctcgtttaaggataagttcggctcccaggagttttttctttccggcaagttctctttcatcgatgccgctacgggagaagggcgcaaggaggactcggcttcctggacgctggaggagtcttatggaaagcttaaggagtggaagtccgggcagaaaaagaaatttctcgaggcaattcaagccaagatcattacggtgggcaacttctcgtccaaattccctctgtttgagagcagcaaggaggacttcctggctttcttggacctgtcggagaggatggcagaagcgaataaaaagaagtcgcgcgaagagaatgagggtaggaagaaggagattgacaaagggatcaagcagctcgcgcagcagcgcggcgagtttttcaacaaaccagggaagcgggtgcagacgagaaagtactacgacatttgtcaaatattcaaaaacatcgccttcaagaggggtggtatcgtggccaggatttcggggattggcaatgagagacgcgagtctcagtcgttgcaatattgggctctgattatggaagaacagaaaaagcattttctgatcatgattccgcgcggggagtctgaaaattacaagaaagcacgcgagtccatagagaaacgccttgctgagcggggcgaaattaagatatatcatttcaaatccttgacactcagggcgttggagaagctctgtttcaaggaaataggtaatacttttgcgcctgagttgaagaagcagggtgttagattccccaggtataagcaggagtggggtggccaggaggagaggatggtcaagttctaccaggaggtgttgacttcctcttatgcgcataatctcctcgacatagccgagttcggggacctccaaagcctccttaagaaggaatataagtctctcgttgactttaggtccgatcttgagaaggctgcctaccttaaaaaagaaatctatctggctgatgatgagaaagagtcattcctccgcaattacgacgcattggtgttcgagatagacagctacgacttgcgcattgagagcgagaaccgccctgagaataagggtcatcaagacaaagcgcatacacggctctggaaagacttttggacttcccaaaacaaagagattgggtacgggactaggctcaatccagaggtgaaagtgttttggcgcgaggcggacgaggaactctcaaagtcactgtcttccggtaagatttcccaacccagaaagctggactatttcagaaatcgctactccagaaaccacttcaatctggcgatcacaattacgtctaatgctatagagaggaaaaatgacctggcctttaagtcaatttccgacatagagaagtacatccagaactttaatgacgacttcaacaaaaactttaaaggcgaatggttttacgggattgaccgcggtttgaaacagcttgcaacactctgcataatgcggtttagcaaacagtcttatccaataaatggtaagtccctgtcctgccctgagttctctaggattgaagcatggcagcttaaagatgaaaactactcagaagatgtcaagcgcgaagacggcacacagttccggaggtcggcgatcaagaacttgtcgtacttcctcgacaaagcggagctctttgaaaagaagatggtttcttgcattgaccttacaacagcgaagatgattaaggggaagattgtgttgaacggtgacctcatgacttacttcaagctgaaggaacatgcgtctagaagaaagattttttcattgttctccgagtctaagatcaacgattcctccgaaatcaagatatcgaagtccggctccactattgtcatcaaggataactgccaggagtaccagcctatatactggatatcacaaagacaagagaaaaaaaccaaaggcatgtatagagagattgagactcctgaacaaatcatcaaaaaactggatggatacctgaaggatatcggcagaaataacattaacgaggatattataaccgtggacaagataaatcatcttcgggatgctattaccgcaaatatcgttggagtcgtcagccacttgcagggtctgtttcccggaataatagcgtttgaggatatggacgaggaggaccatatttctaagcactttacacaatctaatgaaaatatatccaggaggctcgagtgggcattctataggaacttccaggttaaaggcctcgttccgcctcaagtgaagtctaccattttcctgaggaaagagtttaaggataaacaattcggaatagtccagttcgttaaaatggagaatacctcatgcaattgtccccgctgcggagagaagttccccaaaacatcagaccaccggcactacatttgcggtaaccccggatgcggctttagctcgctgggaaatcgcatggagttttctccccttgacgactccgataaggtggccgcattcaacgtggctaaaaacgccttcaacaagctctacgagatttag

SEQ ID NO: 129 - DNA, 3315 bp, Unknown
  Metagenome-Derived Sequence
  misc_feature (1)..(3315): Unk21 Csm1 gene (plant codon-optimized)
atgaaaaactacaaattgacaaaaaccatccggttcaaactcgaagcagatgaaaagaacatttcggacatcaagaaggagatcaaatccatcgaggcgaaatctaacgagtttgaactggcaaatttcgtgacggagttgaacaactatatcgccaatattaaggcatacctcttctaccagagaaaggacggtctttctgcgatcaaggacaagatgacgatcaagaacgaatggcttcggcagtatgccaagcaggagctcgtggagttcaaagttaaaacgcagaaatcgaattacacggggaataagcggagggagcagattacaatttcagaaatctctgagctctcacagaagatcaccaaagctttcgacgaactggtcgttatatacaccgaattggcggattccgcctccctggaactcaacgagcgcgcccgcaaggccaaaatcggactgctcctgaaaagactctgcgcaaagaacacattgcccctgctttcgagcctgatagacaatacttcggataaaaacgagacagacgatcttagcatccggttgaaaaaacaggcaatcaaaattaatgcccagctgcttgtcggaatccgcatgtatcttccggagcaatcaggaggcctcccaatcacaaaggcgagcttcaactactatacgatcaataagaagccggtggatttcaaggagcggattgaggacctcgagaagaagctcgaggtgcaagacctggagaaactcaatatatacttcgataagaaaaagagaacggagaaggactatctggaaaaaaagatctttaaacttcttgaagccgatgttcagaagtctctgcctaaaaatcagacgctctgcctgggggaggccccaatgataaaaacagactcggtcagcctgaggcaatttctgaagaacattaaagctgaacagaaaaagcagttttctgaacttatgcagaacaatatcccgtacgaagagctggagaaatcgaatctctatttgttgaacaatatcaagtcagagcaatttaccgcgtacaaggagaagacaaagaaactcgaggaaatagccactaagttgagcaatcagaatctgtcggaggatgttaagaagaagctgaggtccgacaaagagaagattgctaaagagcgcggcggtatcatgaaggacaattttttcgcctggaagagcttcgcaaacttctacagaagcattgctcagaaacatgggcggattctttcccagctgaaggatatcgaaaaagaaaaagccgaatcccagttgcttaaatactgggcgctcatagtggaggagaacaacacccacaagttgattctgatcccgaaggagaaagcaggggagtgtaaaaagtggttggagacacaaatctatatccaaagcaccaacaatccaaaaatcatctggctcgagtcgttgacctacaggtcgctgagaaagctttgcttcggcttcgtcgaaaacggtaacaacgagttcaaccagaatatcaaagatctcttgcctaaggacgagaatgggtacacgatcaagggggagttcgactttaaaggggatgagcaaaaaaagatcaagttctaccgcagggttttgtcatccaagtatgcgcaacaggtgcttgacatccccgccgaacaaattgaggaggacattatagaccaatcttttgactctctggacgactttaaaatagcattggagaagatctgttattcccgccatgttgtgtgcccgtccgacatagttgaaaagcttaagcactacgacgctcagatcttcgaaattacgagcctcgacctcaagaatccggagaacgttaaggagaaacaggatagattcgagcatttcgataaacatcatacgcagatctggaagaacttctggaccggagaaaacgagaaaaataactttaacattcggcttaatccggaaattaccatcacctacaggcagccgaagcagtctcgcatcgagaagtacggggagcaaaagtctgataagaagaacaggtacctgcacccgcagttcacgttgatcacgactatatctgaacattcgaactcaccaacaaaaattctcagcttcataacagatgaggaatttaagacttccgtgaataagttcaacaaaaacctcaagaaagaaaatataaaattcgcgttgggcatagataacaacgaggttgaattttcgacactcggtgtctactttccggctttcgctaagactactaacgaggagaaaattgctgagctgaagcaggttaaaaaatatggattcgaagtgttgaccattaatgatctcaattataaggagaccgattacaacaataaggagaggaagatcatccaaaacccgtcatattttcttaaaaaggagaactatatgaggaccttcaataaatcagagcaggattacgagaagatgttcgctgagcaatttgaaaaaaagcacctgctcaccctggatctgataacggccaaggtcatttgtggtcacatagtggctaacggcgatatccacacccacttcaatcttcagatgcgggacgctcagcgcttgatatataagatgaatgatcacactcaagaggaaaccatcgggcgcataaaagatttcaagatcaaagaaacagaggcaaagaataaggtttacgttaatatcgatgcaaacttcatagatggcggattcaagagcgtgttcgaaatccggcccgaattctcgaacatcaaactcaaggaggagatcttgtccgagatcaagacgtttaacaccagatccatatcaaatgaagagcttgacttgaagattaatcaccttaagaggtcgataatctctaacgccataggtgtcatcgattttatttataaacagtacaaggaaaggtggggcggtgaaggactgatcgtcaaggaaggctttgacacaaaagaagttgataagggtatagaaaagttcaatggcaatatctacaggattttggagcgcaagctctaccagaagtttcagaattatggcctcgtcccacctattaaatcgcttatggccgtcagagccgatgggataaagggcgataaaaaagccatccttcgccttgggaacatagcgtttattgatccgaccggcacgtcccaggagtgcccggtgtgcagcgagggcgagctggaccatacaacgacctgctccaaaaactgcggatttgagtccaacggaatcatgcactcaaatgatgggatcgctggctttaatattgccaaaaggggattcgagaatttctattag

SEQ ID NO: 130 - DNA, 3369 bp, Unknown
  Metagenome-Derived Sequence
  misc_feature (1)..(3369): Unk22 Csm1 gene (plant codon-optimized)
atgagcacgattataaccgccaaacagctggaggcgctggccgacatctatcaaacaaggaaaactatcaggtttaatctcctccctgtgtccttgtcccacaagaagacaagcgaggacgaattcaagattgcactcggacagttgatagaaaactataaacaggtggtgaacaacttcaatgatactgtcttctcgtgtgagaacgagattgagatacttaacccaaggatcaagataaattgtaggtggctcaaagtctacacgaaacaggatttctatcagaacgctctccgcctcaagaataagaacatagacctcggtgaggcagattttctgttggagattttccaagagtggtctaagaggaattggtccgaagaagtgtgcactgagatagaaaagcctggcatcttgaacgagatcgaggaacttaagaaccagcctttgaattgtcagaaacggaaggcagactttgcgtactgggtgcaccagcttcagacgcggaataactttcccttcatccatgaactgtttgaaaacatcaatgatgagatggggggtgagaacgatgagaggatcgcaaacacgaagaagatactggatatctgcgaggggtgcttgaagaagattgatgactaccttctcccgagccaaagcctgggacaggagattgagcgcgcgtcacttaactactatactatcaataaggagtccaagtactacgagaacgagattaagaacaaggaaaaaacgctcgaggagcctccaacatccttgaggttttacaaggatacgaacttcttgaagaacatctcaaaggatcttccgttctttatcgagtcgctcaacaagagcattcctgagaacgctaaatttattgcctctgtgggggacccgaataaggccgaaaactggtcgctcgcacaagcttatcagattcttaagttttataaggggaaacaaaagagcaatctgatggagtttgtgtctcagaaaccttctttctcagagttgcagaaagaaaagggcttgtcacttatgaagaagattaaggataaaagacggtcgaacgagcaggtttttcaagacttcattacgttggcaaaggagatcgagcaattggggacagagaagtttagactcgatatcaattccgaaaactacccacagcaatcgatagcattgaggaagaagataaaggagactacgcagaaacgcaataagtactttatctataattttaccgagtatatcgacttccacaagggatttgatgaaatcgccaaagagttcggtaagataaatgcggatattaaagggcttaagaaagagaatatcgatgctgaaaggcttcgctcctgggcggtcattttggagaaaaattctcaacactatctcatgaccatacctaaaaaggatgggaagttgcccgaggcctacagagagattaaaagccttaggtccgagtctggcgagaacctctggacgttgtccgtttttgaatcactgacactccgcgcgctcgacaagctctgtttcaagaagatcgacaacactttcattaaatctatagagaaggaactgcgcggaaagtgtcccgagtattttaagagaggtaaatttatgctcaagtcggagttcaaggatggccagcccccggccgagttttatcaggctattttgtccctcgagacaaccgaatccgtcatcctggttaatgaatatttgcgcgatgagaagcgggatatactgctcgagaagaagttcacaagccttcagaacttccagtccgaaatggagaagatctgctacattagaaaggagatcaagatctcgcaagctaccaaagagcacctggaacagaaatacgatgcagacacatatcagattacttcttacgaccttgagaaggagcgccagaaccccgaagagcacacaaagatctggaagaggttctggaaccagaataaaaagtccggttatgtgacacggttgaacccggagatgattatcaactacgtggaacagcggatcgggtcaataaaagacaagggcgaaaaggaggtcaaacggaacaggaggaagcaggcagaatacatccttgccttgactataacagaaaataacgacaagccaaaaacagacatggcacttgcgtctaaagacgccgtgaagaaggacatagaaaagttcaatactgaacgcaatcttatcctctctaatgacccgtattctttttattattatgggattgatagaggacagaaagagctgatcacacttggggtcttcggatttgaaaatcaggatatcgccgtctccggatgggataagaatggttctctcatctcgaagaattacaaaaagccaaggcccgtgacgatcgaggcatacgaactcccacaagagaagtttttggaagagattgaatacactgtgtctaacggcgagaccagatctttcgatgcctataagaatatcagcctctgtgagcaccttcttgtcaggaaagatgtcgactcgtgccttgacctgagctgcgcaaagctcataaaaggtaaaatagtggttaacggggacatctcgacatacctgcagattaagaagaccgcagcaatgcgctacattaccgatggtcttgcccagcaccaattcaccaacgttcttatacaggaacgcgaaggtactctttgcttggaggaagagaagcgcggcattaccacacttgtcgaactctatcatttcgacagccggttcgacaacctggtcgaccgcgcgaaccttaagacagagctgcaagagcactttgacaagatccgggaagaaaacagccaaggtgacatttacaccatcgaaaagatcaatcacctgagggacgctatatgcgcgaatgcggtcggcattatcgtgcatctcctccaaaagtatccgggattgattacactcgaagacctggatattgagcataagtctcgggagttctccaagtactacggtgatgtcggctcgcgcatcgagatagcctttataaataaactgcagacactcggacttgttcccccctcatgtaagatggtgattggcatgcagagcaaaaaagagatcaaccaactgggtatcattcactatgtgaagaccgacggaaccagcggcgattgcccccactgcggccagagaatcgataagaaaactaaggataccaataagtggggcaagcaccagtttaaatgtgacaataacgggaagtcatgcggatttagcacctacgaggataaagatcataaggagctcgatttcctcaagaactcggatgatgtcgcgacttacaacattgcgaagctcgggttcgagtccatagttgtttga

SEQ ID NO: 131 - DNA, 3393 bp, Unknown
  Metagenome-Derived Sequence
  misc_feature (1)..(3393): Unk23 Csm1 gene (plant codon-optimized)
atgatgaacaatattgagaataagaatctctacgaggttaggaaaaccgtgcgcttcgagctggagcctcaattcaaatttaactacgaaaataaggatatagtgaacaacaatttcgacctcaataacttcatagacaagtacagcagcttcctcaaactgttcaatgagatagtgtttaattttaacggggaaaaattgaacggcaagctgaagatcaagtacagctttctcaaatcatacaccaagaatcagtactatgacaacaagatcatcaagccactgaagcttgtgaaccaagtggagatcggttcatcgaagaagttcgaatacttgtttcaaaccttctcagagctctataagaataactttgacattctcaacaatatcaaagagctgtcgcaacggtcactggagaaccagtcaagaaagtcggatctggcggtttatttcagcgagttgagcaagcgcacaaatttcgtcttcttgtatgagctgttcaataactctctcaacatcgagaacgacgaggtctctgttaaaatcgacaaggccaacatactcacaaaggaaattgacgaactgattaagaagattaagaagtcactccttccaactgaagttatcgagaagctgtccttcaactattatacagtcaataagcgcaagaaggactacgataaggagattgaaaataagattaacgacttctctatacagttgaaagacttcaacccaatcctttctattacccactccggcttcaagaattatattagcgacatagcagaaaaatccacactgctgacaattgttgacgggtataatttgatgaagaagtacaaagcggagcagaaatccaatttcctgaaatacctttattctaaatcacggaatgaggactgcgatcttaacattgacctcttctcggatatcctcatcaagcctgagtttaacgaaatcctcgacctcacaaaggcaatcaatattctctcgcaagttaaaactgacatactgaatttgaaggaagccaacgataaaaacaaaaagaactttgagatcgagtccacactcgaaaagtacaacaataactttggaacagattttggtaaaatagagagagataattttttcgagaagataacgaagctcaaaaaactgaggggcgattacttctttgaaggtaataaggaaaagtttaagtttaatgattataaaatcttctgttctgagtataaaaaagtggctaaggaatatgggaacataaaagctaaaattaaagctctgcagaaagagaagattgatgccgagcagacccaatcatgggcactcatcctcgaggagaataataacaaattcttgctcaccatccctagagacaacacaaacaactccgagaacctgtccgaggctaataaaaaaataaaatatctcccctcggacaagaatggcgatatctacctgaatatcttcgattccttgacacttaaagcgttggataagctttgttttgggaaggagaacaatacgtttaggcggaccatctatttcaataaagccgagtaccctgaattcttcaacgacaagggcttcctgaaggataagttcgagttttcgaatttggttaatggccagaaaatcaatgatgagaagctgctgatcaagttttacaaaagcgtcctcgccctggagagcacaaagagacagatctctctgaagttcttcactggcatcgaagatttcttgcagacgaatttcgacacgttggacgaattccaagaggaacttaagaaagtctgctatacaataattcgcaagactattacaaagcaaacgaaggacgagatcattaataattatcaaacaaaattgtataagatcacatcgtacgatttgaaaaagtatgatgaagattttatcaaaacgcttaagtacaagtcggatctgaaacggaagaagataaacaaccacacgcagatatggttggatttttgggagaaggaaaacaaaaataataagttcccaacacggctcaaccctgagatcaagatttcattcacgcagcttaaccttaagtttatacaatcgaattctgaattgtttacaaatcggcatttcgggaatagacttattctgacctcctctttcacgcagaacgccttcggaaaagaccttgacctcaatttcaaggagacacaggacattagcaatttctacgagaaattcaacaacaattttaacaagaacatcaagccgacactgaagtactcctatggaattgatcgcggcgagaatgagctggtgtcactgggtatttttgacttgagcaaagataagccggaagagaagggtgttaaaatacctgtttatgaattgaagacagacaagtttttcgcctacacaaagaccaccagcactggcaagaacatgttcccataccaaaacgttagctactaccaatacgaggatttcccgcactactacaacgagatcaagtatgtgtcatgcctcgacctctcaacagccaagttgataaacaacaagatctaccttaatggcgacatccagacttacttgaatctcaagatcgtttccgctaagcgcaagatttacgagatcatttccaagtcccagcacaagtccgaatctctcgattacgacgattataacactatgatatatattgacggcattaaggggaagaacaaacatatctataagcacaacagcaagtatgagtcaattttgtcatttgatttcgtcaaggacgaactgaaaaaatatattattaaggttaaggtggacctgaatgataacgaggaagtctcgattcagaaggtgaatcatctgagggaggcgctgtgcgcgaacatggttggaattatcgactttttgcagaagatctatcctggaatgatatactttgaagaaaagaatgaagacgatcggataaatcattttaatatcagcaattcctcgctgggctctaaaatcgaacttaagctgttgcagaaatttgcgtcaaagaacttcgtcactccggtttacaagcagatactgaccattaaggacaacaagaagtacaacatcaagcagctcggcatcataggatacgttgatgagaagaatacctcggatagctgccctatctgtggaagcaaactcttcggccatggttcgttcgagtttgagaacctcatgcatcactacaccgagaaatacggctataactacggtgactcgctggataaggcgaagaagacaacgtatgatatttgcgactatcacatgaacgacaagaattacggctacttctttatcaattctggagacgatctggcaacttacaatatcgcaaagaagggcatcgagtacctgaattccaagaagtag

SEQ ID NO: 132 - DNA, 3501 bp, Unknown
  Metagenome-Derived Sequence
  misc_feature (1)..(3501): Unk24 Csm1 gene (plant codon-optimized)
atggagaacaacaacatgtttaacaacctgaagaatctgtatgagttgcggaaaactattaggtttgaactggaaccgtacattattaagaggaacctcattcccgacaataacgttaatgaaaatctcttgaaagaattttacaattcttacaaggacttcatcaacctcttgaagaaaaacttctttaacgataagaatattattggcgaggaggataaagatatcgaaaataaaccgttcgcgaatttgttcaagaaggccgggatcaacatagaaggtaataaccagtcgggcaatcaagacatcgacaaggacatttacgacaattatgagtggtataatacgattcagttcaagtacaaatggctcgaagaagtcttcctgaatgagtggatagacaacaaggagaaaattaaatataaaaatggcgagaagaagcagaagaattacataactttcggagatcttggcgagaacaactttgtgaagaagttcttcataaagttcttcaaggatactgatagcaacctgaaatctctggaacagtacctcaacaatggactcgaggatcagacgcggcggagcgatattttgtttctcattcagagcatcaactccagggactacctcggtaagctttacattctctttaaaaaggacaacatagaccacaagaatgattacaacataatcaaggaaatgaaggagagcattctccaactggaaaagctgataaagcagctcttgaacaagctcaaaccgtcccaagcattcggtctgcccattgagcatatcagcctcaactattactcagtgaataaaacgccaaaggagattgatgatgaaatcaaaaacgaactgaacaagaagaataatatcgataagaagtatatatggaccttcgaagacaaagataacctgaagtctatgttttttaagtccacggataaggaactggagaaagaacttgaaaaggaactcaatcaggaaatgtctctcaaagaattgaagcagaagatcaagctcttcaaggctaagcagaaagccggctttctggaacttctgcagcaaaaaactccattcaagaacttcacaaagccctttgatttcaagtttatgggcgagtcctttgagaagtttaacctcgttctgttctccaagataaacgaagacacgtacaataagatgcttaagctgacggaggagatcgagaaagaaaacaataaggcagaaatcaaaaaactcaagttgaagaggggcaagttcttccaaagagagcttaaacagtttaagggcttctgcgacgcttataagaagattgcccagaagtacggacaggccaacgcgaaaataaagtcactcaagtcccagaaggtggatgccgagaagttgcgcggttgggggttcctttcgcagaagaacaatgactattttattaatacattcgatattgagaacagcaaaaacgtgttcacgaaggaaattaaaaacttgaaggagaacggtaaagacgtggttatctacattctttcttcactgaccctgagggccttggataagctctgcttcaagaaggattccagctttatcaaggagttgatcaataacattgatgacaagttcataaacactaataataaatacaagaaactgaagtctaagaagcaactgcttgaggagctcgaggaaggcgaactgataaacttctacatagagatcctcgagaaacagaaaacacttaatataaagtaccggactgagaagtcccttgatatcctcaaatcttccaagaacctcgaggaattcgagatcaaccttaagctcgagacgtaccacttcatatccaaaaagattagcgaagagacctacaatcgcatcctcaaggaatataaaggaaattcgtacaagatcacatcatatgatattaaacggggcaaacagacaaagaagtacaccacctggtggttcgatttctggaagaaagagaacaagtacaataagtatataactaggatcaatcctgagatgaccatttcgtttaaagagaaagataaaaattttatcgaggacaatcctgacaagaagaggaaccgcaagttcaagaacagattcatccttgccactaatttctcgttctatgccgacaagtactatatcgattctgcattcattaacgaggaaaaacgcaagaattccatcgattcgttcaacaagttgtttaatcagaataacaagctgaagtacatatatggcctcgataagggtactaaggaacttattaccttgggaatttacgaaatcaagggcgaagaactgaaaccagtcaatatcagcgtgaagatacccctttataagatcactaagaagggcttcaagtacttcgaggaaattgaaaataagaacggagagaagaaaaagaggtatctggcgaagaacgtcagctacttcatcaaggacctggagaacaaggaactgttcgagaagcttgaaatcaacagctgtttgggggatctcacatatgcaaaactcatcaaaggtaacatcatcctgaatgccgacatctttaccacgctcaatttttataaaataacagcgaagagattcctcaacgacgcgataacaaagggcaagatagagggcgagaaggttttctatatcgaaaagaataaaaatttctactacaattatgagaaccgctctgagattgagaaaaaggtcatcatatacagaaaagaagagttcgattacctgccctacaacgagcaatattataatagcctgattgaagaaatcgagaacgaactcaactcctacataaaaaagattcaatcgtccttgaacaattccaagaagcaccacgataatgaggacatctcgatacaaaaaatcaacaattacaagaatgctatttcagcaaacattgtcgggatcatcatcaagctgcaggagcatttcaacggctacatctgcttcgagacgctcgacgagggtcagattcagaagaagggactcaagaccttcataggtaacattatcaacgagaagatctataacagattgcaactcaacttggaagtgccgccaatattgaaaaaatttcgcactgacgttggcaataagaagattattcaacacggcaaggtgatctacattaatgagtctaatacatctaaggcctgcccgatatgcaacaagaccctcctggaagtggacaaaaacggtattctgaaggagaaggacggtaaggacgataataaaatctataagctctatggacacctcaagagaaagaatgaaaacaaaatgcgccatctttccgataacgagaaatttcagccgggaaagatcgaaataaacggcaaaatcgagaagatctgtgactacaatatggaaaagaataattacggtctggatttcatcaaatctggtgacgatcttgccacatacaatatcgcgaagaaggcactcgagtatctcaattcgaaaacaaacaactga

SEQ ID NO: 133 - DNA, 3504 bp, Unknown
  Metagenome-Derived Sequence
  misc_feature (1)..(3504): Unk25 Csm1 gene (plant codon-optimized)
atggagaatttccagattaggaagtcgcttaggttcaagctggaaagcaatgaaaataataatctgataaatgaaacaactaaccagctgtccactcgccaggattttgacctctctaacttttcaactaagttggataatttcctcaatgaccttaccgattaccttttttacgaggataagcagggggacctcattatcaaaaagtatcttatcctgaagaacgattggctcaagacctacgcgaagcagcaattcttcatttgtaagaattcgaaacagacccgcggtaaccagagagttcagttcaccatagaagattgcgagctggaggacatgattaccgaggtcagagagaatgtttatgacatatgtgatgagttgtacgagcggtcgcgggctgacctgcatgagaggtataagaggagcggtatcgcggtgctgttgaataggctgaatacgaaggataatttgccatttttggttgatctggtgaagctctctattgacaagaaggagacgtccgaccttagcatcaggctcaagtctgcgggggaggagctcttgaaccttctgaagcaggctatagaacatttcttgccggagcagagctcaggaatgtgcattacaaaagcctccttcaattatcacacaattaataagaagccgatcgattttgataaggagatcaaaaatgttgagtcctctttgctcacgtctcgccaggctcaggaaaggaacaaagggggaatcgacaataacgtctggaagactgcctggatcgatattaacataaaagccaatggcctgccgctttgcttgggagattctcccttcatggaggtggattcctacgcttcactgcgccaaattcttaagaatatattggcgacgcagaaatctcagtttcaggaggcgatgcagcgcggggattcttaccgcgaacttaaagaatcagacctctacctctttaacaatatctccgaggacgaattcaataaatacttcgaatacacggaggaaatagagaaactcgcgactaagaggaatcagactcacgattacaagctgaagaaagatctcgcttccaagatcgaacgcttgaagagagagcgcggctcacttatctcggaggccgacaggcggaatactaactacttcaggacatacaaggagtttgctaagttctataggaaagtcgctcaaagccacggcagggaactggctaagctcctgggtatcgagaaggaaaaggttgaatctcagctccttggctactgggccatgatcatcgaggagaagggggagcacaagcttgcacttattccacggaagaagacgaacgaccttaagcggcgccttgaagaatccaagaattctaaggaggaggtgaagctctactggttcgagagctttacttacaggtcccttcagaagctgtgcttcggtaatttggaaaccaataccaacacgttttacccggagctgaggaaggacggtgctctccttcgcaagttctcgctccaagacaggaatgggtatcctaagttcatatcgggggaacatgaatttaagggcgacgagcttaagaagatcgatttttaccagagcgtgcttgctagcgattgtgctaagaacaagctcaatctgccctatgacgaggtgtacaataacgtggtgaataagcagttcgataatcttgaggattttaagattgcccttgagcaagtgtgctataaaagatgcattacaaccaacaaacacctcatagataatctggcttccgagtttggcgcacagatttttgatattacttcactggacctgcgccgcgaatcaaacactaaggataaagcggagaaatatacgtataaagaaaagcgccccactgagctgtggagagagttctggaaggaggagaacgaggagaaaggtttcgacataagactcaaccccgagatctcaattatctacaggaaggctaaggagtcgcgcatagagaaatacggtgcagactcaaaaaagaataacaggtacctccacgatcagtacactcttgttatgaccttcaacgagcactgtaatacacccaccaagaacttggcttttgccaatatcaatgatgaacaaaaggtgattgaagaattcaacgaacgctttaagaaggaaaacattaggttcgctctggggatcgacaacggcgaagtcgaactctcgacgctgggcgtttatttcccagagttcgagaaggagagcatagaggagaagctcgctgagctgagaaatgtcgagaagtatgggttcgacaccttgaccatcaaggacttgacatataaagaaacagacctgaaggacaaagacaaaaagattatagaaaatgtgtcttacttccttaaggaggatctgtactgcagaacattcggcaagacagcgaaagaatacaaagaaatgttcgaaaaagtcttcgaaaagaagcggctcctctcgctcgacctctcagcggcgaaactcgtttgcggccacattgttaccaatggtgatgtcaaggctctgtacaacttgtggctcaaacatgcgcagaggaacatatacgacatgaacgaccattcaaaaagagagggactcaagaaagtggatttccgctactctgaagatctcaataccgaagaaagacggatcttcattgcgtatctgaacgagggcaacgacaagtacaataaactttcgaaggaggagaagaatgcctacgtggactggctttacgaggcgtgggcagacaatgagatagagaataagaagttctataacgtctataaagaacagaaaatcaagggtgactacctccacaatgttttgcttggcgcgacatatatcggagaagaactccagggggtggaagaaatcgccaacatagaccatataagacatgttttcaagtttcgcgaggacttcgagaagattttcacaagggaagagatcaaaaaagccatagattcatataataagcgcgagatctccaacgaagttctggacctgaacctcaacaaagctaagtcatcaatcgtcgccaacgttattggaatcgtggacttcttgtataaatactacaagaaccggttcggaggagaaggtatcgtggtgaaggaggggtttggcataagcaaggtcgaaggtgataggatgaagttctccggcaacatttaccgcatgctcgaaaggaagctgtaccagaaattccaaaattacgggctcgttccgcccgtcaaaaatattaccgagttcaggggaaaggacaatgctttcgtggagttcggaaacatttgctttatcgactattccgggacctcacaaaggtgcccgatatgcgagaagggtagactcaatcataccgaaacgtgttctgaaaactgcggtttctccagcaagaacattatgcattcgaacgatggcatcgcggggtacaacattgccaagaaaggcttcagggaaatcactaagaaatga

SEQ ID NO: 134 - DNA, 3507 bp, Unknown
  Metagenome-Derived Sequence
  misc_feature (1)..(3507): Unk26 Csm1 gene (plant codon-optimized)
atggagacttacaagatcactaaaaccattcggttcaagcttgaggccgatgaggagaactccatccacatcaaggaagatataatcaacatagagaccaatgataatgagtttactatggtggatttcgtgtcgaatcttgggaactatattaaagatcttaagaattatttgttctacgagaagaaggacggcagcttgtcattcaaggataagataataatcaaaaatgagtggctccgccagtacgccaaacaagatttcgtggaattgaaatctaaaaagagaattaacttgcgcaataatcggatggagcaaataaagattggagacataccgagattgtcttcaaagatagaggaggccctcgacatcgcaaaagagatttactcgaagttgtctgatgatgcgacacttgaacaacatgaacgcacaaagaaggcccaaatcggcctgcttctcaaaaggcttgaggcaaagaatgttcttcctctgctcatggatctggtcaaggagactctcgataaggatgaaacggatgatctgtcaattcgcctgaagcggcagtctcaaaagatcaactcgcagctgaagattgcaatcagatcattcctgcccgaacagtctaacggcctccaaatagctaaagcctccttcaactactacaccataaataagaagcctatcgactttgagaaaaagatagaggatcttaaaaagaaccttaacgtgaaggatttggagaagctgaacgtgtacttcgataagaaagagaagaaacaaaagaactatcttggcaagaagatattctccctgttcgaaacggacattcaaaaagcactctcaaaaaaccaacctctttacctgggagatgcaccaatgatagattctgcatacgtcagccttagacagatattcaagaagattaagtccgagcaaaaaaagcagttctcggagctcatgcagaataaatgctcatacgacgagctcaagaactctaatctgtatcttctcaatgatattggccttgagcagtttaacacgtaccgggaaaagacaaaggagcttgaggagttggcgacaaagctgtcaaaccagaatctcctcgagaatgcgaaagaaagactccggtctcaaaaagagaagatcgcgaaagagcgcgggaacataatgaaagaccgctttcagacttggaagtcgttcgcgaatttctaccgcacagtctctcaaaaacacggaaaaatcctcgcgcaattgaagggcatcgagaaggaacaggctgagtctcagcttttgaaatactgggctctcatttgcgaaaaagagaatcaacatcaattgtggctcattcctagagagaaggcctgggagtgcaaacggtggctcgagacagtcaacgataccagcattgacaatgagaattccataaagctttactggttcgagtctcttacttacagatccctccagaaactgtgtttcggcttcctggaaaatggcaacaatgagttcaaccagaacataaaggatctgcttcctaaggacagaattggcaataccatcaacggagaattcgctttcgagggggacgaagagcggaagattgagttctataagactgtcttgaactcgaagtatgctaagcaggtcctcaacatcccgttcaagcaggttgaagaggagattatctctcagtctttcgaaaacttgtctgacttccaaattgcacttgagaagatttgctaccggagattcgcgatttattcaaattacataatctcgttcgatgcgcagatcttcgatatcacaagcctcgatctgaaaaataacgagaagaacaatctgaatacacacactcatatatggagagatttctggaaggacgagaatgagaaaaataacttcgatatccgcctgaatcctgagattacaatctcatatcggaccccgaagcagtctcgcattgaaaagtatggcgaaaagacaaaggagtacgatcctaataaaaacaatcgctacttgcatccacagttcacactcataactacaatttccgaaaggtccaattcccaaacgaaaacgttgtctttcatcgaggacgaggacttcaagaaatcaatcaatgagttcaacaagaaactcaaaaaagataatataaagttcgctttcgggatcgataacggcgaagttgagctctctaccctgggagtctacctgccgacgtttgagaaagaaacacacgaagagaagatttatgaactcaaacagattaagaagtacggctttgaggttctgacgataaccgacctgaaatataaggagacagattacaacggtaatgtcaggaagattattcagaatccgtcttactttttgaagaaggagaactacattaggacattttcaaagtctgagcaggagtacgaggagatgttcgccaagcttttcaagaaggagcatgtcctcagcctcgatctcacgacagccaaaatgatctgtggccacattgtgactaatggagatgtcccggccctcttcaacctctggttgaaacacgcacagaggaacgtgttcgagatgaatgaccataccgtgaaagagacggctaagacgatacgcttgcggaacaacgaggagctcaccgacaatgagaaggaaaaatttgctgaatttattagcgatggtaagaagtttgcaaaactcacgaaggagggcaagaagtctaggtacctcaaatggatatttgaggaccgcaaggagaactcgttcacagaagacgagaataaaaaattcaatgattgccagaagaagaagggcaagtacaattcccacataattttcgcctcaaggttcgagggggacgagctgaagagcgttacaccaatctttgactgccggcatgtcttcaagaagcgcaaggaattcgagactatcagaccaataaaagagatcgagaacgaaatttcacgctttaacacgaaccggacgtcgcataacatctcgaacgaagagctggatttgaaaattacggacgcgaagaaggcgcttgtggctaacgccattggggtcatagatttcctgtataaacaatacaagcaacggtttaatgatgaagggctcataatcaaggaaggcttcgatactcagaaggtggaggaggatattgaaaagttttcgggtaacatctatcggatccttgaacggaagttgtatcaaaagtttcaaaactacggccttgttccgcccatcaaaaacctcatggctgttagaaatgagggcattaaagacaagaatgcaatcctgagattgggtaacattgcatttatagatccgtctggcacgtcacaggagtgccctgtgtgcaaagagaaaagcaaggagaagcacactaataacttcatttgcgagtgcggattcaactccactaatattatgcattcaaatgatggtatcgccggtttcaatatcgcaaagcgcggctttgagaattttatcaacgagaaataa

SEQ ID NO: 135 - DNA, 3516 bp, Unknown
  Metagenome-Derived Sequence
  misc_feature (1)..(3516): Unk27 Csm1 gene (plant codon-optimized)
atggaaacttacaaaatcacaaaaacaatcaggttcaagctcgaggctaaggatgagaatattcccgagatacagaaggatatcgcaggtctcgataacaatttcgacctcgccaatttcctgactggccttaaccactatatcaacgatatcgataagtatttgttcgaaaagaagaagaacggcaattctgtcataaatggaaaaatcacgattaagcctgacttcctgaagaactacgctaaacaagagtgggtcaatttccaggaaaaaaacaagcttacccaaaatgctacgcagaattccaggccgcgcaaagaaaggaacagcattaatgagttcaccgggctggacgaaaagatcaaacaaactttcaaagaggtcgcggatatttacgagacccttgctaacgatgcttcagccggtctcaacgaaagggccaagcgggagcatacggggctcctcctcaaaagactccaggcgaagaataccctcccataccttatttccttggcagagaacagcaacaacaaaaacgagacagacgatttgtctatccagctcaaaaatcagagcagcaaactcgaacagcagctggctgcgggaatacgcgaattcttgccggctcaatcttcaggccttccggtggcaaaagccagcttcaattactacaccattaacaaggcgccaattgacttcatcaaaaggatcgaagagttgaagaaaaacctcaaggtcgatgatcttcaaaagctcaactcgtttttcgacaagaaatcgaagaaaaataagctctattttcacgataatctttttaagctcattcaaacagatgtgcaagagcaactcaagaacaacaagattttgctgctgggcgatacttcgatgctcgatattgaaaactatatctcgctccgccaggtcctgaagaacatcaaatcgacacagaaaaaaaaattcagcgagtggatgcagacggacaagaactatgacgatttgaaaaagacggagctctatctcttcaagaatatatccttggaccagttcattgattatagggaaaagacaaaggagcttgaagagctcgcagtcaagattaaccaggcagctaacggggaagagaggaaatctctcatctcaaagaaggaggctgtcgccaagattagaggcaacattatgaaagataagttcgaggcctggaagagcttcgctaatttctaccgcagcattgcgcaaaaacatggcaggatactggcccagctgaagggtattgagaaggagcagacggagtcccaattgttgaagtattgggcgctcgtgctcgaatccaacaaccagcataaactggtcttgataccaagggagaactcgggcgagtgcaagaagtggctggaagaaaatgacaacagatcgtcgcctgggtcacggcacatattttggttcgagtcgttcacgtatcgctcccttcaaaaactctgctttggtaacttggagtctggtacgaacacgttcaataagacgattcaaaacttgctgttgaagtactccaagggaaagcccattaacggcgaattcgcgtttgaaggagacgagcagaagaaaataaagttttacaaggatgtcctccagaatcaaactacgctcaatcttccccaggagaaggtgcaaatggaaattatcaacaaaaatttcgcctcactgggggatttccaaattgcgcttgagaagatttgttacagacggttcatagtgttgaattcagatgccgaaaagatcctgctgaacaagttctacgcccagatcttcgatataatttccttggatttgaaaaacctggagatcattaataacaaacaagagaagtacctccataatgataagagacatacacagatttggaaggaattctggaccagcaaaaatgaagaaaactcctttgatattcgccttaaccctgaaatcattatcacataccgccagcccaagcagtcccgcattgacaaatacggccagaactccaaactgtccaaccggtacctgcacccgcagttcacactgattacgactatcagcgaacattccaattcgcccacgaggattctctcgttcgtgacagatgaggagtttaagaatagcgtggatgagttcaacaagaagctgaagaaggacaacattaagtttgcattcgggattgataatggggaaaaagaactgagcactttggtcgtttacctccctgagttctcgaagaggactccggaagaaaaaattgccgagctcaaacagatagaaaaatatggcttcgaggtgttgaccattaacgacctgaactataaggagtctgattacaacggcaaggagcgcaaaattatccagaatccatcctacttcctcaaaaaggaaaactacatgcgcactttcgataagtccgagagggagtacgatgagatgtttgaaaagttgtttaagaagaaacggactctcactttgaacctgacaactgccaaggtgatctgtgggcacattgtcaccaacggggacgtgcccgctctcttcaacctctggcttaagcacgcccaaaggaatatctttgaaatgaacgatcatatcaaagacgagacggccaagcgcatcatcctcaagaataagctcgacacaaataaggagaagctcaagttcgccgagtatatcagccataaagaaaaattcgacgagttctcagaagttgagcaggagaagtacgtccattggatctttgaggacagggagaagctcgatttcacgaccaaggagaactcgaagtttaatgattgtacaaagcgcaagggcgactacagaacagacattcttttcgccagctgctttattggggatgaactcaggagcgtgactgacattttcgactgcaggcacattttcaagaagcatgacgagttttacagcataaagtcagagaaggagatcgctgccgagattgagtcctttaatacaaaccgcacttcccatgacatttcgaacgaggagctcgaccttaaaatcgtcgacgccaaaaaggctctcgtggcgaacgcggtcggagtcatcgacttcctctacaagaaatacaaggaacggtttaatggggagggacttatcgtgaaggagggttttggaaccagggaggtggagcaaggtatcgaaaagttcagcggcaacatctatcgcattcttgagagaaagctttaccaaaagttccagaactatggtttggtccctccgatcaagagccttatggccatccgctccgagggcctcaaaggtaacaagaaggctattctgcagctcggaaacgtgtgcttcattgctccagatggtacatctcaaaattgcccaatttgcgagaccaagatgaataacaatcatgcagacgaaatcgtctgcaaagtttgcggttttgaatccaagaatatcatgcattcaaacgatgagatcgccgggttcaacatcgccaagaggggttttgagaatttcaactaa

SEQ ID NO: 136 - DNA, 3516 bp, Unknown
  Metagenome-Derived Sequence
  misc_feature (1)..(3516): Unk28 Csm1 gene (plant codon-optimized)
atggagaacgctaccatcaagaatcccaagtacagctatatgaagtcgatcaggttcaatctgatcgacactgacaacaaattgtccgatctcaaatcaaactccaaccaggactcaattattaacctcgacaatatattctcgtcttacgacaagttgataaaggaattcaagtcccttttcttcgaggttgataagaacaaagactacaagagaaacaacagcgaaaactacattttgaagaggacgataaaaataaagaagcagtggttcaagacgtacttcaaggagggctggaacttcaaggaagaaaaaaaacaagaaatagaaaaaacacaaactaagattaacgagactgtctcaaagttcgagaacctttgtaagcagctgagaacagacatagatcatgacaagaacagggctcacaagaagcatcggaactcaaatttttcgtccatcctgcaacagattaagaacaaagacgtgttctacctcttgaacgatctcgtcaagcaaagcatcaataaaaatgaagtgtcgaaagtcaacagcctgattaaggacttttcctcgtttgaaaagaagcttaaccagctgagcaaggagtacttggcctcgcaatcattgggaattgagctttataggtctagctttaactattacacgctgaacaagtcgtctaaacactatttgaagcagattgagaagaaaatacaaaattataaagacgaaaaaaataagactcatattgaattccagaacaatagcatcaaggttaatgacatgaaacttcagctgacttccaaagatttggaggtcatggagaacataaagtccgagcttaagatcaaatttccccttaaccttgaggagtccaaatattttatgaagctctttaaagcgaagcttaagtctgatctgttcaaggattgccaaaaaaataatgaaattaaggattacagctgcttgttcaacgagaacaaaaaacttaagaaaatctttgatctcacccgcgagattcagaatgaaaacgagttcaaagagatacagaatttgaagaaggaccgcggtgagatactcaagtcgttcgaaaattggaaaaactttattaactcctatcggaagatcagccaggactacgggaggattaagacaaacattgctaactacgagaaggagaagatagattcccagaagctgcgctattggaacctgttcctgaaaaaagacaatcagatatatatattgttcgtcccaatcgaattccggcaggacgtcaaggaaaaaattactaatgcgaacaccgttaactcaccaaataagatctttatgataaaatcgcttactaagagagcgcttcacaaactgtgcttcaatgagtatggttcttttctgaacgagatgaaaaaaaagaagaaggagacctacaacgagataatcaaatttaagcagaagttcagggaggaattcgagcagaacaagatcgagaagttgaatcaggagctcatccaagaattgaagaaaaagaagattaagttcgagaatgatgaacttaaaagatccaagaattttgttggattcatgaaaaatttcgagaataagaagtatggacagttcaagaagcagttcaaggagaagatcgagaagctcaatcagaaatacaccaaacaaaaggaggagaagacaacaaagatccttaaggaggttctgcagtctgactatgctaagtcgaggcttgacctcaaggatttcgatcttcagaaagtctacctggcccagacttctaatgagttcgaggaggaattggaaaaggaatgctacaagatccttccgtattacatagacaacaagctgcttagcgaattggaaacgcttttcaaggttttcaagtgcaaaattcaatcctatgacctcgataagaggttcaagaacgagacgcagaccccgaagagccttgagaaaagacatacaagggagtactggaacgagttttggcagaaattgaaccagtctaaaattcgcttgaatccggaaatacgcgtgaattacaaagaaaaggacaatgaaatggagcgctatctctggaagaggtataatgtcgataaggagaagatcaaggagaacaagtatgggttcaaccggaacctgcaagataagtatatcattaatttttccttcttggtgaacaccgggaaaaagtttctcgaccttggctttgctgacagcaatgagatcaaacacgaaatcgaagactttaatattgacctcaataagaagatgaaaaatcctttcttctgcgggattgatatcggggaggttgagctcgcgtcaagcgcaatttacgcctttgacgacaagcataagtatcaattcaacaaccagaagttcataaggccagtcatcccagacaatttgccgataaagtgcctgcgcctcaaaaaggagtattacaccaaatcaaggaagccatctaagcaaaaggtcaactttaaaaaaatcgaggagaggcaaatcatctcaaatttgtcttacttttccgaccaggaagagctgttcgatgaaatatcgccgtttgcccttaacctcacctgcagcaaagtcatcaatggagtcattattgaaaatgcggacatcctcacctacttgcaatatatgaagaagctcgccaagcggaggctcttcgagatctattctaagggttttctggagactgataacaaaaagcacaattttcaggacttgaagttggattggcagtaccctaaggaaagcaacaaatacaagtccaacaatttgatcttgtgtgacaaagaaaataagatcgtgaaggcaaagatattcacgtttatctacgagtacgagggcattaagacgaaaaatggggaatacgagtttgactcgatgaaggattattttaataagtaccttaacaaacttaagaaaataaagaagtcaaacgataataaaatcattaaggaggatatccctaggataaacaacctgcgggacgcgctggtttctaatatgattggcgttctcaatttgtttaacaagttcgtggacctttacgttgtgctcgagaacattccgaataagaataagcaggatgagtatctcataaagaggttggagtctgctctgttccaaaaattccagacgttcggaatggtccctccgaatgttaaaaatctgatcaagataaaaaagatgcttcaaacaaaggaagataaggactccggtaaagagatccagatcggtaacatcctgtttataaacgagagaaagacctcacaaacttgtccatactgcgagaactcggacaacaaccaggaccatgagaaaggcatcttcctctgtagcaagtgtaatttctcgacgaatgacaaggaaaagatccacctcaccgagcttaagatcttgaaatcatgtgatatagtcgcagcgtataatattgcaaaaaagggataccaattcattattaatggcacgaagcacaagaatattaagagcgaatga

SEQ ID NO: 137 - DNA, 3564 bp, Unknown
  Metagenome-Derived Sequence
  misc_feature (1)..(3564): Unk29 Csm1 gene (plant codon-optimized)
atggaaaagtataaaataaccaagacaatccgcttccggctcgacgcagataacacagccatttcagctatcgtcaaagatacagaagctcttgaagccagaggtcagggtttcaagattaagaaatttgtcaatgcactgggccggttcctgtcgggcgatggagtgcagaagtatctttatgatatgtccaacgaggagaattgcgttttcaagcgcaatctcgtgatcaagaatacatggctcaaaaataatgcgaaacaagagattgctggaatggatcttaagagaggcctgataattaaagatatcaagggccttcaggacaaaatagaggaaatttacgacaagctgtgggagatttacgaaattttgtacgaatctgcctacttgcctcttcaggacttggcgaggagagaaggtatcggccttctcctgaaaaagctgtcggtgaagaacgcgctgcccttcataatctcatttgttgaagagtcgaacgacaagaatgaggcagatgacctgagcttgcggctgaagaagcaaggtaaagagatcctcacccagctggaaatcgggatcaatgaatatctcccggcacaatcgtccggccttcctgttgctaaggcctcattcaactactacactattaacaagactccagtcgatttcggagaaaaaatccaggagctggaaaaaaggctgtcggttgatattaagaaggagatttcaagctttacaggtgggataaagacagcaatcaaaaataagatcgccggaaaaaagatcttgctgggtgacaccccgatgtttgagtccgagaactccgtgagcttgcggcagatcctcaagaatataaaaagcgagcagaaagcgcagtttaataaatttatgacgacccaaaataatccacagttggaagaaatgaagaccatgggttggtacctcttcggagacataaccgagggtgaatttaacgactataaggaacaaacgaaagagatagaaagggtcggtgccaagattaatcaatgcggcaatattaaggaaaagaaagaactccggtctcagcttcagaagcttaaaaaaaaaaggggcgagctgatatctgaggcgcataagaagggtggaaacgataagaatttcaaaacatacaaggagttcgccaagttctaccgcaagattgcccagagacacggcaagatcctggcacagataaaagggattgaaaaggaaaagatcgattccgctatgctgaactattgggcagcggttatcgagttgagcggaagacacaaacttgtcctgatacccaagaaggacgagaatgctaaaaaatgcatcgaatggttggaggatgagtccaagcacaagaacgggtcatgtaagattttctggtttgaaagcttcacgtttagatcattgcaaaagctgtgcttcggaaacctggatagcggaacgaatacatttaatcaaaaaattcaaaaccttctcccctgtgatgaaaggggtaatctcatgaatggtgaattcgcttttaagggtgacgagcaagaaaagataaagttctacaagaaggtgctccagagccagaaagacattaacttgccgcagaaggaggtggtcgacaatgttgtcgggcgcaagtttgaaaccatggatgaatttaagatagcactggaggagatttgttacataagacgggagaggctgagcgcgaacgccgaatctgaactcaaaagcaagtttaatgcacagatcttcgacataacttcgctggacctgcgcaacccagtcaactgtgcagggaaaccggaggtgtaccatcataatgacaagagacacacagagatctggaaggagttctggtcacttgataacgaacgcaggaactttaatatccgcctgaacccggaaattaccatcacataccgcaagcctaaagagtcacgcatacttaagtacggcaaggggacggagaagtacaacgccgacatgaagaatagatatctctatccgcaatacacgctgttgaccactatctccgagcattgcaacactcccacgaagatcctgtccttcatgactgacaatgaatatgaagaatcaatcaaggcattcaatagcaagctcaaaaaggaggacataaagttcgcctttggaatcgatagcggtgaaactgagctgtcgacactcggggtgtatttgccagaattcagcgcggaatcgactgagctgaaagatatcgaaaagtacgggttcaatgtgctgacaataaaagacctgaattacacagagacggattacaatggctctgacaagaagattgtcaagaacccgtcctattttgtggataaatctctttatatgaggactttcaaaaaaaccgaacaggagtatgagaagatgttcgcggaacagtttgaggcgaagaagcgcctgagcctggacctttccgcagccaaggtcatttgcggccatatcgtgacaaacggtggggtgagcgaacacttcggcctctggttgaagcatgctcagaggacaatcttttggatgaacgatcacacggagaagaagaccgccaagaacataaaactcaaagactcgtccgaactcacttacgacgaacgcgaaaaattcgcggagcatatatcctctgacgagaagttcaagaagctcgacgtcgaagaaaagaaaaggtatgttcgctggattttcgaagaccgcgaaacgctcaattttactgaggccgagaataaaaagttcgggggttaccagaagaaaaaaggggattaccgcctgggaatactgttcgcgagctgttttatcgggaaggaacttgagtccgttactcaaatcttggactgccgccacatatttaagaagagggaagagttttattctttgaagtctaaggaggacatcgaggcggagatcaagcgctacaataccgattacaccaaccacaatatttcgacagaacagctcgacctgaaatttgtcaatgtgaagaacgcactggtcgcgaatgccgtgggtgtgatcgatcttctgtataagcagtacaaagagaggctggggggagaaggcctcattgccaaggagggatttgacacgaaaaaagtggaggaggacatggagaagttctctggtaatatctataggatcctcgagagaaagctgtaccagaaattccaaaattacggcctcgttcccccaattaagaacctgatggcagttcgggcagataaggttgaaattagcgaggccgaaaagtcgaagatacgcgaaaactgtaagatatccaagatcgatcccgagaatgaaattattaaaagaaacaaaacacttatactgaggttgggtagcattgcattcgtcaacgatgctgatacatcgcaggagtgccctgcttgtggaacaaaatccaaagagaaacatgtggataatttcatctgtggctgcggattcaattctacggggattattcactccaacgacggcgtggcaggattcaacatcgcgaaacgggggttcgttaaccttatggagcacgaactgaggtga

SEQ ID NO: 138 - DNA, 3573 bp, Unknown
  Metagenome-Derived Sequence
  misc_feature (1)..(3573): Unk30 Csm1 gene (plant codon-optimized)
atggagtcatacaaaaccacaaaggccgtgcggttcaggcttgaggcggatgatgcagcagcgcctttggtggcgggggaagtggcagccctcacggcggttgggcagggctttaagatacgccgcttcataaatagactcggcgaatttcttggcgaaggcgttcaagagtacctgtacgacgcagagggaaaggtgaaggataacctcgctgtcaaaaatacctggctcaaatccaacgcgaaaagagagatagcaggcatgatcgcgggtatgaagctcaggcgcggcctcgccgtcaaggatatcaaaggtctcagggagagcatcgagaaggtgtttaacgatgtctgggacacttacgagaagctcttcagctcggttgacctcccactccacgatctggcaaagagggctgcgatagggcttcttctcaaaagactgcaggtgaagagcgccctgccgtacttgatcagcttcgttgaggattcatcggataaaaacgagaccggggacttgagccttcgcctcaagcgccaggctaaggatatattggaacaactggaagccggggtctatgagtacttgccgccacaatctggcgggctcgaggtcgcgcgcgcaagcttcaatttctatacaatcaacaagaagccggttgacttcggcaaggaaaccgagaagctgaacaacagcctgattgtgtctgccgaggaaaaagtccaccgcggaatcaatgtctctaaggaagtcaagtcagcgatcgttaacgacattttggatagatccagcggcaagaagatcttgctgggggatgcacccgaacacgatggggaaggctgcgtcagcctgcggcagatcctgaagaacatcaaatccgagcagaaggctgctttcaacgagttcatgacacagaatccgcaattcgaagcgcttaagggaaagggctggtacctcttctcagatatcaccgaaaacgagttcgacgactacagaaaacaaacaaaggagatcgaaagagtggcgacgcaaaaaaatcagtgcgaacggggcgacaagaagaagcttttgcaatcagacctccagaagctcaagaaacagcggggcgcactcataaatgccgcgaacaagaagggcgggaatgagaacaattttaagacatacaaggcgtttgcggatttttatcggaaaattgccatggaccatggcaaaatattggctcgcctgaaggggatcgaacgcgagcgggtcgagtccgcgacactgaagtactgggccgtcgtcgcggaggtgaacaataggcataagctggttctcatccctagggaaaacgccggagcgtgtagggtgtggctcgacggtggcggacaccgcaacggagcctttaagatcttctggtttgaaagcttcacgttcaggtccctgagaaagctctgtttcggattcgtcgagaatgaaacaaagagcaacactttctacgatgagtggaaaaaagagctcacagattaccgcaatgtgagctcagagattgatcttaacgtcacccccggagaccgcaagggttacactgaggaggaactcaggcaaaatgagcaaagaaagattaagttctacaaggcagtgctcggttcaggctgtgccaagagatccctcaacattcctaccgaacaggtgaggaaagagattgtgaacagagagtttaaaaacctggatgaatttcagatcgcgctggagaagatctgttacctgaggttcgccactctttcggccaatgccgaagccgagctcaagaagtacaatgcccagatttttgacatcacatcgctcgatctcaaaaaccctgagtctgccgccggaaaggccgagaagtatgaacactccgataagcgccacaccaaaatctggaaggaattttggaccgctgagaacgaaaacgccggtttcgagatccggttgaacccagagataaagatactctaccgcaggccaaagcaatcacgggtgaacaagtacggagagggtacggagcgctacaatccgaataggaaaaataggtaccttaggccgcaatatacattggttacgacgatttccgagcactccaattccccggcgaaggaagtgagctttgtcagcgaaaaagagtataccgacctgattgacgagttcaacggtcgcttcaagaaagaggatattaagttcgcgttcggtattgacaatggcgagactgagctctccacattgggcgtctacttgccagcctttaaaaaagataccaaggaagagaggctggctgaactttctaatgttgagaaatatggatttgatgttctcgctatcggagatcttaactacaaagagaacgattgcaatggaaaggaaaggaagatagtccagaatccttcttattttctcaacaaagacctctacatgcggacgtttaataagacggaggctgagtacggtgagatgtttgcccgccagtttgaggagaagcgccttctcacgctggatctcaccactgctaaggtcgtttgcggacgcatcgttactaatggtgatgtgccagcccttctcaacctttggcttaaacacgctcagagaaatatcttcgaaatgaatgaccacattaaagataagaccgggaagaagatacttctcaaagataagttggacactgacaatgaaaagaggaagtttgccggctacatctcgcacaaggacgagttcgacaagttgagcggcgaggagaaggctcggtacgtccagtggatattcgaagatcgcgactcacttaatttcacgaagggcgaggaaaacaagtttgagaggtgtcaggaaaagaagggcgattaccgctctggcgtcctcttcgctgcctcctacacgggtgtggatctgcagtcggtgacggacattttcgactgcaggcacgtttttaagaggcgcggtgaattctattctatcaagccggagagggagataaaacaggagatagactccttcaacacgaacaggacatctcacgcgatctcaaacgaagagctggacttgagaatcgtccatgttaaaagcgccctcgcggctaatgccgtgggggttattgacttcctctatcggcagtatcgcgagcgcttcggtggggaggggcttatagtgaaggagggattcgatactaagaaagtggaagaagatatggagaagttcagcgggaacatctacaggatattggaacggcggctgtaccggaagtttcaaaattacggcctggtgcccccgatcaagaacttgatggccgttagggccgaaggtatgagggctgacgagaagaactctaagccagacctgggcgcgatagtcaggcttgggaacatcggcttcgtgaatgagacttacacatcgcaggagtgtcccgtctgtggtggtaacctgaaccatgaaaaggtgtgcccgaaaaattgcgggtttaatgacaaaagattcatgcactccaacgatggaattgccggctttaatatcgctaagaggggattcgaaaacttcctcaatgaaaagcatggtggggcgcagtga

SEQ ID NO: 139 - DNA, 3585 bp, Unknown
  Metagenome-Derived Sequence
  misc_feature (1)..(3585): Unk31 Csm1 gene (plant codon-optimized)
atggaatcgtataagatcaccaaggctataaggttcaagctcgaagccgacgaaaaagcaatccctgccgttatgagggatatcagcgctttgaggaaaaccggcgatggagcagacattaaagctttcgcggaggaactgtacgagttgctcggctacattcacgactacctgtacgacgagaagaacgatgacgattatatcttcaaaagagggctcacagttaagaatacctggctcagggataatgcgaaggacgagacgtccggtcagacccttaaaagagggctgacaatcggagacataaaagggaaggattcaaggggcagcgacctccaagagaatatagagaaaatcttcgatgaggtggtcgacattcatgagcgcctggagtcagctataaactcacccctgcagtctcttccaaggcgcgcgtcgatcggattgctgttgaagggcttggcccggaagagggcgttgccttatttgatttccttcctggaaggctcagatgacaaagatgagaaatcatctgtgtccctgatcgcgaaaaagcgcgccaaaatcgttaccgatggccttgaacgctgcatccggcattatttgcccgcacagtcccacggccttccggtggcaaaggcttccttcaactactacaccgttaacaaaaaggaaatcgactataaaggcacgatagagaagctcaaaaaggacctgaaagtcggctcgttgaaggaggatctcaaccgcatatttgacaatcttaaggcatcaataagcaaggaggtcaagaccgaactgctcaatgacatttcctctcgcctcagcaacggatctgagctctttctcggatatgcaccggccgctggtatcgaaaatgggaactacctcagacagatacttaaaaacatcaaatcagagcagaaggcggccttcaatgagttcatgacacaaaacccgagcatcggcgcaataaaggataagaaactctacctcttcagcgatatcagcgagggagaatttaacgcctataaaaagctgacggccggtattggggatgctgctgccaagatcaatcaagcgaggaacgatggagataagcagagacttcgctctgagctcaacaagaggaaaaaggagaggggcgagctgataaacgcagcgaatcgccgcaacggaaacgagaataacttcaagacatacaaagcctttgccgaggtctacagaaagatcgcacagagacacgggaagattcttgcgcaacttaagggcatcgagcgcgaacggatcgaatacgatatgctcaagtattgggccgtgataatagaactcggcggacgccacaagctcgtcctgatcccagaaaaaagggcagaagagtgtaagaagtggttggaaacttcagacgagtccaatcggaagaacggatctgtttgctggtttgagtcattcacgctccggtccttgaagaaactgtgcttcggcaacttggacagcgggagcaatctctttaactcgaccatcagaccgttgctgccaaaggatcgcagaggagaggccatgaacggtgactttgcttttgccaagtcggcagccgagaggatgccagaagcaagcgagcaggacatccttaaggaagctgaaagcgaaaaaataaagttctacaaaaacgtgctgaaggggcagaaggcactgaacaatttgccagaagaagagatccaaactgagatagtgaaaaaggactttaactctctggaggcctttcagatcgcgcttgaaaagatatgctatcgggtgttctactctctttcagcgaatgccgagcaagaactcaaggacaagcacggcgcacagatcttcgagatcacctctctggacctgaagaaccctgagaacgttaaagataagcaagagaaatatgcccacgcggataaaagacacactaggatatggaaggatttctggactgcgggtaacgaaaaggggaggtttgacactcgcctcaaccctgagataacaatcacatatcgggagccaaagcagtcgagggttgataaatatgggaaaggatccgcgaactacgacgcaggaaagaagaacagatatctgcacccacagttcactctgaccgctacggtctcggagcactccaactcaccggcgaagaccttgagcttcatgacggacaaggagtttaaggagtcggtcgacgatttcaacaagaagttcaaaaaggacgatataaaattcgccttggggattgataatggagagactgagctcagcaccctcggggtgtatctcccagcgttcgggaaaggtgccgcgaccgaagagaagattgcggagctgaagcagatcgagaagcacggctttaaggtcctgacagttaaggatttgaattacaaggagacggacagaaacggtaaggagaggaagattgttcagaacccaagctactttctgtctaaagaaaactacacgcgcaccttcaaaaaatcagccgaagagtacgagaagatgctggccggtgtctttgaggaaaagcggatcctgacactcgatctcactacagccaaggtcatctgcggccacattgttaccaacggcgatgtgcccgccctttacggactgtggctgaagcatgctcagcggactgttttcgagatgaacgaccacggtaaagcaaagactgccaaagacattaagatcaagccgaagctcgatacggataaggaaaaactgaaatttgccgagcatataagcaaaatcaaagaattcagggggctcacggccgaagagaaagcgaagtacgtgaaatggatatttgaagatcgcaagccgggggactttaccgacaaggaagccgagacgttttctgactgtctgaaaaaaaagggagattataggtcagggatagtgtttgcgtcctgctacgtgggggaggagctcaaatcggtcactgaaattctcaattgcaggcacattttcaagaagcgggaggagttttattcaatcgactccgaagaggaaatcacggcaaagctcgagggatataatacggacaggacatcccataacatctcgaatgaggaactggatcttaaaatcactgatgcgaaacgggccctggttgcaaatgcggtcggtgtcgttgatttcctgtataaatattacaaacagaactcagggggtgaaggcctggttgttaaggaagcctttgacgcgaagaaggttgaagaggacattgaaaagttttcaggtaatatctatcggatcctggagcggaagttgtatcagaagttccagaattacgggttggtgccacccatcaagtctcttctggcagtgcgcggggagaaggaggagttgcgcctcggcaatgtgtctttcgtcaaggaggagggcacatcgcagcgctgcccagtttgcggagcgaagtccgacgagaagcacacagatagactgaagtgccagaagtgcggctttgattcatatggaatcatgcatcggaatgatggtattgccggattcaacatagccaagcgcgggtttgagaattttatgaaagaggagcggaaataa

SEQ ID NO: 140 - DNA, 3630 bp, Unknown
  Metagenome-Derived Sequence
  misc_feature (1)..(3630): Unk32 Csm1 gene (plant codon-optimized)
atgctggagtctttcaaagatctttatgaagtgcggaaaacagttagattcgaattgaagccttccaaagtcttgcccaagatcaagattaaaaacatcgatgagaatttcatcaacgagtttttctcgaactacaacaagctgttggagatttatgagaaggtgttcttcaacaacagagagatcaacgggaagataaagttcagcttcagcttcctcaagacgaacctcaagaaagagtattacgaactcggcatagataagatcaagaaatccgctagcgttaataaaattaagcttgaaaagatagataattacgagaagctcaacagctctttcctttcaactctcaaaaagcaaaatgagtacgtgaattcattcaaggagaagattgagtccccgtacgagaatcggtctagaaagagcgaacttgtgttgctcatatacaaccttaaaaagaggaataattttccctttatagaaaacgccttcaacaacgtgaccgccgaaaacattatggtggacgacgagatcaaaaagggtaacatgttggcgaaaacaatctctaatcagctggtgactatcgaggaggaactgctgccgcaaaattcgatgggcctcgtgatcgaacgggccaccttcaattattttactataaacaagaccccaatcgattatgatatcgcgatcaagaacaagaagaacaaatacaacgagataatcggtaagcaaaacaaattgaaaaacacttacaagaagcaaagcattaacgaattcattaagtacatcatcgaggacggattctccaaatttgaaaaccagatttatgaacaaaacggtaagtacatcgacactggcaggaagggctcgtcttttaatgagctcacgatcgagaacgcctacacgctgatgaaaaagtataaatcggatcaaaagactgcgttctacgagatcattaaaaaggagaagtacaactttctcaaaagccaaaataataagattactatcacctacaataaggattcctttaacgacaaaaaagaggagataaccgtgaaattgttcaatgacatctcgaagggtaacttcgataagatagccatgttgacgaagaagattgagaccctcgccgagctcaaaaactacctggagaaaaaggaattcaacaagttccaggagaagatcaataccttgcaagagattattaatattaacttcaacaacgataatgaggaagaggtggaaaaccttgttaagaggttgaatgcggatcgggtgttgctcaagaaagaaagaggaacatacttcgataaagagtccaacaattttgcatttacgaaatataaggaattctgtgaagtctatcaggaggttgcgatgaccctcggtaaagcgaaagcagatatcaagtcgcttgagaaggagaaaatacaatccctttttttgaagtcttgggcactgattgtggaaaataaagagaagaaccagttccatttgcttaccattccgaagaagaatatctcaaaagccaggaacatcatactcgctctcaaaaacggcgagaacaacaacaatattctgtaccttttcgagtctcttaccctcagagcgctcaagaagctgtgttttggtaaagagtttagcgagaacaggggcgattacacagagaaatcatctccgttcaggaaatccatagaagagaatatcacgaattcagactttgacaacataaatttctacatagaaaaacagaaaaaggacggtaataactatcgcgtgttgaagcaatattatgacttctatattaataaggaggaaaacaaagaactggatgaggagctcctcatcaaattttataagtcagtgctgcagttgccttctaccctcgagcaaatcattataaaaaatttccccgattatgaaagcttcatcagcaaagagtttaacaatctggaggagttcgaggaggggattaaacggaccttctatataaagcaacccctgaagatcgaggaacacaagctcaacaagctgatcaaggagtataactggaacctctataagattacgaactacaacctgataaagaacgacttggacgagatcaaggagcttaaggagaaggagagattcaaccggaatcacatcaaaaatcattccaagctgtggtggaacttctgggagaaggagaatatagataataaataccccattaggataaacccagagatagccatatcgtttgtcaaaaaggatgacaacttttacgaagagaatcacaacaagctctttaaaaaccgcagattccaggatagatttcttcttacgacttcgatgacagagttcgcaacaaacaaaagcatttatttgtcttacaaggagctttctgagcttaagaatttttataatagctacaattacaacttctccgagaacttcaagggggaatatatatacggtattgataggggtgataacgagttggcctccctcggcttgtttcgcaatattaataagaatatcgaggcggtgaagattgaaacttacaagcttaaaaacgagaatcttctcttcaaggaaggtacctcaaacacgccagcttacaagaacatctctaactacatcgagaaagacgagctcttcgagatcaaggaagtgtcatgcatagatctgactcttgcaaaactgatcaagggtaagatcgtcctgaacggtgacatatccacctatattaacctgaaaatcacggcagctaaacgctctctttataacatcttctcaaagggcaattataaggagggcgatattatcgagaagggcaaattcaaagacaaaaatacgggggaagagggctacgacggcacccttaaattcaatcagaaggaaatctacaagaacaattcggaaattgagaaaattatctccatcgacaaggtcaagaacatcctggaggaatacattgaggaaatcaagcagaatatctacaacgaggacatctcaatcgaaaaaatcaaccatctgcgggacagcatttgcagcaacatgatcggcatcataaattttctccaagaaaagtatagcgggtatatgtttcttgagaacaagaaaatcatcgactccaataaaaactttctcaaagatggctaccagctcgggacacggtttgagcaaaagcttctgcaaaagtttagcaatctcaaccttgtgccgagcaattacaagttgttcttgagcatcagagatgaggacaaagaaattaagcagcttggaatcatccgctacatcgatgaaaattcgacttcgtcagcctgtccggtctgcaatcctaaactttacaatgtgaattcagatgacatcaacaagctgtatggtcacggaaaaggagaggagaaagagaaatcgatgcaccacatcaatgataaaaacgatgagaaccatcaagagggaaagtgggagtcaggaaaattggagtcaggtgacctttgcgactttcatattggctacaatgagaaatatcctgatttttctttcatcaaaagcggtgacgatcttgcgacgtataacatagccaagaaagcccttgagtacctcgaatacctgaaatcgcttaataatgatgagacaaaatag

SEQ ID NO: 141 - DNA, 3774 bp, Unknown
  Metagenome-Derived Sequence
  misc_feature (1)..(3774): Unk33 Csm1 gene (plant codon-optimized)
atggatgcggataagacaactaaggctatcaatgagtaccaaacccaaaaaaccataagattcggactcaccgccacgaaccagaacctgtacagcgaggagatcatgaaattgcttaatatttctgaggagcgcattatcaaggagaaggttaaggttaacaacgatactgataaaactaaccagctcaggggatgtttggtgcagatcaagaagtacctgaaaacctgggaaaacatttacgctcaaattgattttctggcaattaccaaggactactacaaagtcatatctaagaaggcgaggtttgatttcgacaagggtaatggctcagaaatcaaactttcatcactccagtcaacgcataacaagaagaagagatatcaatacattatcgacttttggaaggagaatctgcgcaagacagaaaatctgtatcgcaagtctgatgaccttctcaagatattcgaggaagctaaaaaccagaatagggatgataaaaagctcaacaaggtcgagctccggaagacgtttctcaacctctttacactcgtcaacgagtcgctgaagcctctgattgaaggcaacttgttcattgttaatgacgataagattgatgagaaaaactcaaagcataactacgtcttttacttcatctctaagaccgaggagcggaggctcctctacgacaacatctgcaccctccaggactatttcaagaacaacggaggctatgttcccttcggtagggtgacactcaacaagtggactgcgctgcagaagttcaacaacagggatatcgagattaatagaatcataaaggaactcaaaatcaacaacatttcaacacagaagacagattacaaatataacgatttcactgagaattttaaggagaagaaggatgagaatggaaaagttgtcaagaattccgccggcaacatcatttgggatttgaaagccaacgccaagagcgtgattgagatctgtcaattcttcaagtataagaaggttcccataaatgcgcgcttgaacctggccaagcgccttatcaaggacaataagttgaagaaggagcaggaaaataccttcctctccgaatttggagttcttaagactcctgcgttcgattatgctcgcgacaaggagaatttcaacctcaccaactaccccctgaaggtcgcgttcgactatgcatgggagaactgcgccaaggataagtatgaaaagattccgtttccaaaagagcagtgtgagcgctatctccaaacggcctttgagatagacgctacaaaggatgaaaacaagaagctgatcgacacccacctgaacaagtacgccgacctcctccagttcaagatccttcttgagaggtttaaggctgaattccacaagactaacgaggaaaccaataagaacaatatacagaaactgcggaacgtcttctccggactcgactaccatggcgacaataggctgaataagaatcagatacaaaaggcgatcgaagcatggtttgataataaggaacaaaacattggcaaaaaaaaggagaatgagaagttgctgaccgaaaatgagaagaacaacttcagcttgtccatgcagattatcggacaggaacggggtggactcaagaacggcattcccaagtacaaggagcttactgaaatgttcaaagtttgtgcgtccaagtttggaaagcagttcgctgacctcagagattacttcaatgaggcatacgaggtggataagattaaataccgcgcctggattatcgaggacgataagaagaatcggttcgtgctgttcgtgaacaaggaaaaagcgtttgatctcacctccgaggaaggagacctttggttttatgaagtgaagtcactgacctccaagtcccttgtgaagttcattaagaacagaggagcgtatccggacttccatgatgttaaaaactcttttcattattcttccatcaaaaaagattggcaaaactataaaaacgatccagagttccttgacaaactgaaggaatgcctgaagaactcaaagattgctaaggaccaaaagtgggcaaaattctgctgggactttaaacagtgcgacacttacgaaaagctcgagaaggaagtggacagaaagggctacaagctggagggctgtaagtcggagcccaaaacgatttcactcacgcagctgacggactgggtcgagaataaggactgttttctgctgccaatcgttaaccaggacattaataagggggacaaacggacgaaaaatcaaaaccagttcacaaaagattggttcgatatttttgagaacaaaaagagactgcatccggagttcaacattttctaccgcttccccacaaaggattatccgaacactaagttcaaaaacggcacagagaagacgaagagatatagcaggttccagatgctcgcctactttggctgtgaggtcatcccgagcgggaatcacttgtctaaaaaagaacagatagctatcttcaacaacgacaaaaaacagaaggaggaagtggagaagtataataagagcattagctcagactgtgactacgttattggcatcgacaggggtatcaagcaactggcaaccctgtgcgtcctggataagaacggggtcattcaaggcgactttcagatattcacccggactttcaacaaacagacgaagcagtgggagcacaaagaactcgagcaaaggaacattcttgacctgtccaatttgcgcgttgaaacaacaattacgggtaaaaaggttctcgtggatttgtcgaagatcaaggacgatgaaggcaattatacaaacctgaagcagactatcaagctgaaacagttggcttacatacgggaacttcaatacgccatgcaaaccagaccggatgatctgttggactttgtcaagagcattaattccgcgaacgacatcactgcagagaatattaagcacttcatttcaccgtacaaggagggcaagaactacgacgatttgccgaaagttgagatgttcaatctgctcaaggaatggggcaacgcagatgagaacggcaagcggaagattgctgagcttgatcccgccgataacctcaaatccggtatcgtcgcgaacatggttggcgttgtcgctttcttgtgtgaaaactacaattacaaggtccgcattgccctcgaggatttgacaagggcgtacggcattcaaaaagatgcacttaacggcactgccatctaccagaacgacgaggatttcaaggagcaagagaataggaggctcgctggagttggcactatgcagttcttcgaagtccagctgctgcgcaagttgttcaaaattcaggtggacaagaacctccatctcatcccagcattccggtcggtcgacaactatgagaagatcgttcgccgggacaaacagaactctggggacgaattcgtgaactatcctttcggcattgtgtgcttcgttgaccctaagtacacgtcccagcagtgtccttattgtaataacacgcacaagcataagaagaatgacactgagaccggtaagaaggctttttataggaacaagggcgagaataagaactcactgctttgtgagaagtgcggagtttctacaatcgaaggggaggagacactgtcttccaagaatgataacaagaagcaattcaacatacattacattacagatggagaccagaacggtgcgtaccacatcgcgaataaagtcgtcataaattttcaaaaggattcgtga

SEQ ID NO: 142 - DNA, 3831 bp, Unknown
  Metagenome-Derived Sequence
  misc_feature (1)..(3831): Unk34 Csm1 gene (plant codon-optimized)
atggaaaagatcaagaacaagtaccaagtgagcaagacattgaggttcggacttacgcaaaaagagaagcgccggaagaaaggattcgtcggagaggtttacgagtctcacaccgagcttaaggatcttaccgatttctcggtcaaaaaaatacgcgccgaaattaagcaaggcggcaattctggtatccccatcgagaagattcgccagtgccttatcgtcatcagaaggtacatgaatttttgggagaacatctactatcgctgtgaccaactctcactggacaaagacttctataagaagctgtctaagaagattggcttcgaaggtttttggcacgaggagaaccggaaaacagaccatagaattaagaaacctcaggcaaggaccatccagctgagcgaactgaataagaaggatgatcactacaaggagaggaaagactacatagttgaattttgggagtccaacataaacaaggcggctgagcgcttcaaagagactgagtctgttttcgaaaagttcgagattgccataaatgcgaatagggacgataacaggccgaacgaagtcgagatgcgcaagatgtttctgtcacttgccaatattatctacgagacactcgttccgctttgtaacggcagcattagcttcccaaacattgagaagatgcagaacaacgaggaaaacaataatctcagaaaattcgctgccgatgacgaatttcgcgccggccttcttactcaaatcgaagagctgaaggcttacttcgaagagaacggcggcaatgttcattactgcagagctacactcaaccctaaaacggtcatcaaaaacccaaactcaacagactcttcgatcgcggacgaagtggagaaaacaggaattgaacgctacctgcagaacaagcaggaaatcaaaaacaagatcgaaaagatcaaagataaaaacctgccgctcattgagcgcgctctgctgttcaagtataagactgtccctgcgggcgtccaattcgatttggcgaagttcttgtcagtgaagctcggcaagaccgaacaggaattgagaaccatcatccggtgcataggccagattcaaagcccggcagaggattacgccaagtcagaggataaaaagggttttcacttggaacaataccccttgaagtcggcctttgactttgcatgggagagcctcgcaaaggctatataccataaaaacgtcgacttcccccagcagcaatgcaaggtgttcctcgaaaaaaatttcgatataaaaatagattccaacgccaacttcaagctctatgcacagcttctttatttgagagaaaacctggctaccctggaacatagcaagccgacggatcccgatacattcgagaaaaacatcaggaagcttctcgacgagataaattggtctacgattgataaggagaagggttcagtctataagaatgctatctcagattggttgaagaataagaaggcaaaggacgaaaagtttggtaaggtgaagcaatctattggattgtcgaggggcagacttaaaaacaagataaaaaaattcgacgatctcaccaaggattacaaggatattgctacacagctgggaaatgccttcgctgcaatgagggataagatcacaaatgcagccgaattgaataagatttcccactacgctacgatcattgaggacaaaaacggtgacaggtacattttgctccagaaagtgacagagaatgaaaagccagtgggcgagaactggaacaagaatggagagctgaaaacgtatctcgttaacagcgtcacttcagccgccattagcaagatgataaggaaaattaggacagatgaacttaggaaaaatgaaaaaatgcagtcctccatcacgaagctgaatgaaaaacaaaaggaagagaaaaacatcaatgactggaaaaactttatcgaggagaagcgctgggacctcgaattcaagctcgatttgaagtccaaaaattttgagcaaatcaaaaaggagattgacacaaagtgttacttgtttaacaccggttacgcgtcccaagccgatattaaacagctcgtgaaggagaaagatgcactgctgttgccaattatcaatcaagacctggcttcgaaggataagatcgttaggaaccaattctccaaagattggcaaatgatcttttccgacaactcacaaggctatagactcacccctgaattcagaatatcttatcgccaaccgacctccaattaccctcaacctgaggaaaagaggtattcaaggttccagatgatcgcccatttcctcatcgactacattccgcagaataatcagtacatcagcaccagagagcaagttgagctttttaaggatgagactaagcaaagagaggctattgaggaatttcataagcaactgacacccaagactgaggcagagcagaaggccgagtcgctctcggctctcgccgcaaaattcaacaacccgaataataagaagcagaaaaacaacgcctctgagaacaagccggatgaaaaattttatgttttcggtattgatcgcggacagaatgagcttgcaaccctttgcgtcattaaccaagacaagaagatcatcggcgacttcgagatctatatcaggaaattcaactcggaaaagaaacaatgggagcaccttaagttggaaaaccgccacattctcgatctctcgaatcttagagtggagactaccatcgtcattgatgggaagcccgaaaagaagcgggtgctcgtcgatctgagcgagattaaggtcaaggataagaacggggaatacaaaaatcccgacaagatgcagactaagatgagacatctggcgtacatccggaaagtccagtttcagattcagaataaccctgagggcgtgctcgacttcctgaagaagttcaagactaagaacgaaactatatataatctggttgacaaagagaatggtgaaaagggactcatatccttctacggcgcgggaaatacaaatgaagacctcccaaaagatgatatttggaagatactgcagaagttccaggagttgaagaataaaacgggcgacgataatgtgaagaaggagattaaggaacttatagagcttgagccagtggacaaccttaaaaacggcgttgtggcgaatatggtcggcgtcatcgcgtacctcttggagaagttcgactaccaggtgtacatagcattggaagacctcacaaaacctttcaatgaggatataaaggatggaactaccggtgtgaagggcaattataagggtgaaggaaaacgggctgatgtcgagaagtacgcaggacttggactctataacttcttcgagatgcagctcctgaagaagttgttccgcatccagcaggagaacgataatgttttgcatctcgtcccagccttccgcgccgtgaagaactatgaaaaccttatcgccggaaagggaaaaattaagaaccagttcggaatagtgtactttgtcgacgcgaactcgacctcaaagacgtgcccggtgtgttcgagcatccccgacaaaaataactcgaacaacaaaaacgccaaggggaagaaaattataaataagaagggtaacgagtctgttatttgggtcgagagggacaaatcaaacgggaacgacatcatccgctgttacgcatgcggcttcgatacaacaaagaattactcggaaaatccgctgaagtacataaagtctggagatgataacgccgcatttattatcagcactttggggatcaaggcatatgaactcgccaagactctcgtggccaacaagtga

SEQ ID NO: 143 - DNA, 3831 bp, Unknown
  Metagenome-Derived Sequence
  misc_feature (1)..(3831): Unk35 Csm1 gene (plant codon-optimized)
atgaagtcctttgagaattcgtgtcagatcagcaagacattgaggtttggtgcaacgctgaaggaagataagaagaaatgtaagtcacatgaagagttgcaagagtttgtggacatctcatacaagacaatgaagtcttccgccacaatcgccgagtcattgaacgagattgagctggtgaaaaagtgcgaacgctgctactcagaaatcataaagttccatgaggcatggggccaaatatattgcaggaccgatcaaattgccgtgtacaaggatttctaccggcagctggctaggaaagcgaggtttgacgtgggagatcagaattcacagctcatcactttgtcctcgcttagctcaaagcacaacgtttaccagggactcaaacggtcacaacacattacaaattactggaaggacaacattgccaggcaaaagtcgttcttgaaggacttctctcagcagctccatcagtacaagagagctctggaaaattccgacaaggctcacaccaaaccaaatctgatcaattttaacaagactttttcaatcctggcgaacctcgtgaatgagattgttattccactgtcgaatggtgcaatctccttcccgaatatctccaagctcgaagacggagaggagagcaggcatctcatcgagttcgctctcaatgattattcagatcttgtgggcagcattggagagctgaaggacgctattgcgaccaacggaggctacacgccgttcgcaaaggtgacactcaaccattacacggcggaacagaaacctcacgtcttcaagaatgacatcgacgctaaaatcagggagttgaagttgatagaactcgtcgagaagctcaaaaacaagacttccaagcaaatagaagaatacttttcaaaatttgacaagttcaagatctacgacgacaggaaccagtccgtgataattagaactcaatgtttcaagtacaaacctatcccctttttggtgaaacacgagctggcaaagtacatcgccgaagacgaggacgcggttcttaaagtgctcgacgcgattggagccacgaggtccccggcccacgactatgctcataacgaagacgtgtttgatcttaagcactaccctattaaggtggcattcgattatgcttgggaacaacttgcgaacggtgtttataccacggtgagctttccggaggaaaagtgccgcgagtaccttaacgcaatatatgggtgcgaggtgactaaggagcccgtctttaaattttacgcagatctgttgtacatcaggaagaatctggccgtgcttgagcacaagaataaccttccgagcaacccggaggagttcatttgcaaaattgagaacacgttcgaaaagatcgttctcccgtacaagattaaggagttcgagacttacaagaaggccatcctgacctggataaacgacggcagaggacacgaaaagtatactgattcgaagagagaattgggtcttatacggggtggtcttaagggcagaattggcgctcagaagatgtttagaaagaataagaagggcgagcttatcccatactatgaaaacccctacacaaaacttacaaatgaattcaagaacatatcctcaagctatggaaaaacctttgccgaattgagagacaagtttaaggagaagtccgagatcacaaaaattacccatttcgggatcattatcgaggataacaacaaggataggtaccttttggcgaatggactccaacacgataacacggatcaatcgaatacacaagtggaggccatcctgggtaagctgaatacgagcctcgagttcaccacctaccaggtgaagtcgctcacaagcaaaattctgataaagctgattaagaaccatacgacatcgcccaacgctaagtcaccctacgcggatttccatacttcaaaaatccatgtcgattggacaaagatcaagaaggagtgggatacgtacaaatctaatcacagcctgcttcaatatgtcaaagattgcttgacgaattccacaatggccaagaaccagaattgggccgagttcggttgggatctggagtcatgtaactcatacgaggcgattgaacatgagattgaccaaaaaagctatattctccagaaacacacaatctcaaaggcatcgattaagagcctcgtggagaatggatgcttgctcttgcccatcgtgaaccaagacattacttctcagggacggaaagacaagaaccaattctcaaaagactggaaacaaattttcgaggacagcaaggaatatcggcttcaccctgaattcgctgtgtcttacaggacccccataaaggattatccaaaggacaaacggtatggtcgccttcagttcatctgcgctttcaattgcgagattataccccagaatggcgaatttattaatcttaaaaagcaaatagaaaacttcaatgatgaggatattcagaaaaataacgtggccgaattcaacaataaggtcaacgaagcgctgctcggcaaggagtacgtcgtgattggtatcgatcgcggcctcaaacaacttgccacactctgcgtcctcaacaagaggggaaagattttgggtgattttgagatatacaaaaaagagttcgtcagaacagaaaatagaagcaagaactattggaagcatacccttgcagagaccaggcatatcctcgaccttagcaatctgcgggttgaaaccactgttgaggacaataaagtgcttgttgatcagtcgcttactctggtgaagaagaatagagacaccccggatgagaaggccactgaagagaaccggcagaagatcaagctcaaacaactctcttacattcgcaagcttcagtatgcgatgcaaacaaacgagcaagccgtgctggatttgcttaaggacaactcagacgatgaggaattcaagaagcgggtggaaggggttatatcacctttcggcgagggacaggaatacgcggaccttcctattgataccatgagagccatgattcaggacctccagggtgttatcgccaagggaaataagcaaaccgaaaaaaataaaataatcgagctcgatgcagcggactccctgaagcagggcgtggtcgcgaacatgataggcgtggtgaatttcattcttgctaagttcaactacgaagcttatgtcagcctcgaggacttgtccagggcttataacgttgcgaagtccggatacgatggacggtacctcccctctacgtctcaggaccccgatatggacttcaaggaacaacagaatcagatgcttgcgggcctgggaacatatcaatttttcgaaatacaactgcttaaaaaacttcagaaaatccagtcaaacaatacggttctgcgctttgtccccgcgttccggagcgccgacaactatcggaatatcataaagcttaacccgaagtatgacaacaccgagtacgtccataaaccctttgggatcgttcactttatcgatccaaaggacacatcatcaaaatgcccggtctgtggtaaaaccggcaagaaaaacgtggaccgcaacgagaaaaaaaataatattctcttgtgcaaggcatgcggttttcgcactgtctgggagcttaagcaacctgaaaacatcaagtctgagggctattgcttctcggaggacgagattcagaagacgataaaaaacaaccagaagcaaatggagattaaaaagctgtcagacaaaaacattcactatatacataatggggatgataatggggcgtatcatatcgcactgaaatcagttgagaacttgaagcataaggagtag

SEQ ID NO: 144 - DNA, 3894 bp, Unknown
  Metagenome-Derived Sequence
  misc_feature (1)..(3894): Unk36 Csm1 gene (plant codon-optimized)
atgaaatctatagttaacaactatcaaatttccaagaccttgaggttcggtctgacacaaaagactaaaattcagaaggaaggttacaacggagaaatttacgtttcacatagggagctctgcgacctcgtgaagatatccgaggagaggatcaaaaagtctgtctccgcttcggataaaagcaacctcgagctttctattgacataatcgacacatgcctgaaacagatcggggttttcctctcggattggcagcaggtgtactaccggaaggaccaggtggcattggataaggactattacaagattctctgtaaaaaaatagagttcgacggcttttggaaggatgatcgcggacaaaggatgccgaactcgcgcatcattaacatttccgaattggacaagcgcgattcgttgggcgtggagcggctgcactacatactcaattattggaaggacaaccttgtttcagcctcccagaagtacagcgctgtggaggagaagatcaagcggttcaagtcagccattaaaattaatcgcactgataacaagccggatgaggtcgaacttcggaagatgtttctcagcctcgccaacattgtgtgcgacaccctccaacctctgtgctacgggcagatatcctttccaaagattaataaactggatgactcaagaaccgacaacaagaagctgataaagtttgctaccgaatacaaatcgaagaacgatctgcttacgagcatagctgagcagaagaaatatttcgaagaaaacggcggcaatgtccctttctgcagggcgactctgaatccgaagacagccatcaaagacccgaacagcacagataacagcattaaaggcgagatcgcacagttgggcttggattctatcttgaagtcgtttaagtcttatctcttttttgaaaactccttggaaaatatgtccgcaaaggagaagatagatctcatgaagtcggacggcgccagcatcataaagaaggggttgatgttcaaatataaaccaattcccgtgatcgtgcaccgcgaagtggcgcaggagctgtccgaggaccttaacaagacagaagaatccctgtccgatttcctgcggggcatagggcaagcaaagtcgcctgctaaggactacgaagaacttactgataaaaacgaatttaacattgaagcgtacccgatcaaggtcgccttcgactttgcatgggaatcgctggcgaaggctaagtaccattcagagatagacctgcctgtcgattcctgcaagaagttcctgaagacctttgacgttacgccagacgatgcgaactttttgctctatgcgcaacttcaggagctgaacgccctcatctctacccttgagtacggctatccttcagatgagcagagcatagtgaagaagataaaggcactttccaatgagattcagtgggagaaagtctcggacagaaacggacaggaatataagaggtcgatatccgattgggcagacggcaaacgcgactctgatggtttcaaaattgcgaagcagaatataggtctgttcaggggcgggcttcggaataagatcgacaagtactactctctcacgcagatctataaaaagacggtcatggacgagggtaaaatattcgctatcatgagagacaaaattatcggcgctgctgagcaaaacaaagttacgtactacgccgccatcatcgaagacaacacaggagacaaatacgtgctgctgcaagagctgccactcaacgggcaagacagaatttacgataagatgacgagggacggagacggatacgtgtgttgtttcgttaactcgataacctcgagaacaatcgccaaacagcttcgcaagaagagaatggctgagctcaagaaaaataaggcgtggggcgcttacaacgataatgtgtctaacactcaacagcctgttttgtcagatgaagagaaggaggagcggaacattagagaatggaagagcttcattagcgaaaaaagatgggattgcgaattcaacctgaactttaaaggcaagaattttgaggagatcaagaaagagattgacgccaaagggtacgaactcgagaacagaaggctgagcagggaggcacttgacgagctggtcaagaacaacaaatgcctgctgctgcctatagtgaaccaggacatcataaaggagaataagaccgaatctaaccagttcactaaggactggaactctatctttgacgataacagcccctggcggttgacccccgaattcagagtcagctaccggaagcccactccagattacccggtctctagcaagggtgacaagcgctattcacggtttcaaatgattgcgcatttcctctgcgattatataccgaattccgattcgtacgtgtcggtgcgggagcaaatcgagaactacaaggatgataaaaaacaggaaactgccgtgaaggacttccataatcgcctcctggggaagaccgaggaacaaaagattatagataggctcggcgcgttccaaggctggggcaatgtcataatcaaaaagacgaagccggagaagcaagaaggcagcaaagaaaaattcttcgtcttcggaatcgacagggggcagaatgagctggccacactttgcgttatcgaccaggacaaaaagattcaagggggtttcaaaatctatacacggtcgtttaattctgagaaaaaacagtgggaacataaatttcttgaagaaagaaatatactcgatctctccaatctcagagttgagacaactattgtcattgacggccaagaaaagaaagagaaagtgcttgtcgacctgtctgaagttaaagtcaaagaccacttcggaaattatgttaagcctaataagatgcaggtgaagcttcaacgcctcgcctacataaggaaactccagtttcagatgcagacaaaccctgaaagggtcttggaatggtattctcacaatcagaccaatgacctcatcattaataatttcgtcgacaaacagaacggggaaaagggccttgtccccttctttggggcagctgtcgccgagctcaaggataccctcccgatcgacagaatttcggagatgcttaagcaattcgtggagctgaagaacctggaaaagcagggagaagaggttaagagcaaaattgaccaactcatagagctcgagcccgccgataatcttaagtctggcgtcgtggctaatatggtgggggtgattgcgttcttgctggagaagtactcttaccaagtttatattagcttggaggatctgagcaaaccgttcgaaaaccaaatcgtcctgggcatctcaggtgtcccgattggcataaacaaaggcatggctgggcgctccgtgaacgtggagaaattcgccggcctgggattgtacaacttctttgaaattcaattgctgaaaaagcttttccggatccagagagacagctgccacatactccacctcgtcccagcttttagggcaatgaagaattacgataacgtcgcggtcggcaagggaaagattaagaaccagttcgggatagtgttctttgtggatgcggctgcgacttccaagacctgcccgtgttgtggcgccaataactccaagaagtttgagcctgatttcaggaagtttccaaatgcgaagaaattcgagacgcctgacaagaaatcggtctggcttgaacgcgacaaatccgatggaaaggatatcatccgctgccacgtgtgcgggttcgatacgtcgaaggagtatgacgataacccgcgcaaatatatcaagtccggtgacgataatgcagcttacctgatttctgctgagggtgttaaggcttatgaacttgctacgacacttgttgacaacaagtga

SEQ ID NO: 145 - DNA, 3948 bp, Unknown
  Metagenome-Derived Sequence
  misc_feature (1)..(3948): Unk37 Csm1 gene (plant codon-optimized)
atgattaacctggaaaactttaagaacctctatgaggtcaggaagaccgtgagattcgggctcaatcaaccgaacaaaaagggggacttcaaaacacatctggagtttaaggattttaccgagaagtcttttcagaatgtcgagaacgaactcgcgtctaacggtaagtacaacataggagatgaggaacagctcatcaagaagatctcagccttcgtggaacagttgaagatccagctcggttattggaaagtgttttaccagcgctacgacctcattgctatcaataaggactattacaagatacttgcgcggaaggcgaagttcgacgcaatctgggagataagcaaatccaacaagtacatcaaggtgaaacaaccacaggcttcacaaatctccttgtcctcgctcaagatcggcaaccgctccgattctataattcaatattggggtgagatcatagaaaagacagactacttgcttaacatcttcaagccaaaacttgaacaatacgagcgggccattaaggacgccaataatgcgcatattaagcctgactcaatcaattttagaaagaccttccttcagctcctcaaattgaccaaagaatttcttcagcccctttccgatcggtcaatcatcttcgagttttctaagaaaaaggtcagcaaggagatcgaaaagatctctgagttcgctggcgagaaaaataatacaaaaatctacaacgtgcttaagaacggtgaggagctccgccagtatttcgaggcgaatggctctcaagtcagctatggtcgggtgtcactcaattactatacagccgttcagaaaccaaataactttgatcaagaaattaaaaagtcaattgacgacttgggaatcatcaattttctgaagaaatcagactctcaaatcatagactatcttcaccagggatccaaacaaaagattaagctcttgttgacctctaagcatccatatcccatagaattgctgcaactgttcaaagtgaaaccgattccattttccgttaaatataacctcgccaaattcgtcgaaaagaactataaatcagagactaacctctcatatgaggacatcctcaataaatttaatctcctcggccgcgcgatagatatagcgaacgacttcaagaactcgaaccacaagggcaatttctccttggacgagtaccccgtcaagctggcttttgactatgcctgggagaacacagctcggtccttgaaaagagatatatcattccctaagaaggtgtgcgaaaggttccttaaggacaattttgacattgacgtcgataacgccgactttaagctctacgcgaacctgctctttattgcggacaaccttgcgaccattgagtataacaaccctaacaacgaagccgagcttatcaacgagattaaacaagctttcgagtgcatgtctttttcgttcgaaaagaaggtctatgagggacacaagaaagctattctcgagctgctcgataaggaaaaatcccagagagactattcgactattagcaaggcgaaacaggaactcgggctgttgcgcggcgggctcaagaacaagatcaaaaagtatagggatctgacccaaagactgatcgataagaagaatagccacttcggtatcgcgtctttcattggtaaaactctggccacgatcagggacggactgaaggaggaaaacgagcttaacaaaatctcccactacggggtgatcatagaggacaacaaccaggataagtacattctgataagcaaactcgagggtaaagatagacgggacaaaatagtccagaaacttggcaagggagacattaaggtgtaccaggttaattcctttacatccaaggctctcaataagttcatcaaaaatcctttgtcagaagacgctaaaaagttccacggaaagtacaaagacgagtacggattcgggtacgagaacaagaacggggactttacatacaaggtcaagaatgttagcgaatacgatgagcaggggaagtggatcgggtatcaagaagagttcttgaatcatatcaagaaatgcttgatcgattccgaaatctcccgggaacaaaactggacagcgttcggctggtcttttgacggctgcaataactacgaggagatcgaaaaggagattgacagcaagggctaccagctgaccgagaacagcatatctaaggggaacctcgagagcctcgtcaaggacgaggactgctctctcttccctatcataaaccaagatatctctagccagaagcaggagaataagaacattttcactcttgactttgaaaaagtctttgaaaggaaggagtgccggatccatcccgagttttcgatattctatagaaagccaattgaggaacataaaaaggaaaataagtcgggcataatcaataggtttggaaggctgcagctcttggcgaacctgggtatcgagttcgtgccccgcaacctgagcttcaagacaaagaaagaacagaataggatcgcgatcgaccagaaaaagcagaaccagctcgtgcaggagttcaaccaggagaaggttaatacatatttcgaaggcctcgataattattacatatttggaattgaccggggtatcaagcaactggctacattgtgcgtcaccgataaaggcggcgttattcaggattttacgatattcacaaagcactttaatcaggctagcaagatttgggagtacagggagaacaggaaagaaggcatccttgacctgacaaatctcaaaatagagtctgacaagaacgggaatacctacatcgttgacattagcctgttcgatgcgaaagatgataatggcaggtccactggaactaataaacagaatattcagcttaagcagctcgcctacatcaggaagcttcagtatcagatgtcggccaatgagaagggagtcttggactttatcgcaaaatacattagcaaggacgaaagggagcagaacataaaagagctcattacaccctataaagaaggtaagaaattcgcggaccttcctatggatatatttcaagagatgtttgaaaactactatcggctcaaaacagaccagaacctttctgagttcgagaagaaaaacctcatgaagatcacaacagagttggacgccagcgagaatctcaaaaaaggtgtcgtggcgaacatgataggcgtcatctactacttgatgaagtactacgattacaaggtgaaaatcacgctggagaacttgaaccagtcgttcggcgggcaagtcgacggcatcaacaaccactatgtcgacatcaagaataattttatgtatcaggagaaccaggctttggccggtgttggaacctaccattttttcgaaatgcaacttcttaagaagatctttaagatttccacagaggaaggcatactgcacctcgttccgagctttggttctgttaagaactattttaaggatattgaaaagtactctttgatcgttaatattggtcgcaatgagaagtataaccagtttggcgtggtgcattttgtcaaacctgataacacatctaaaaaatgccccgtgtgcctgaatactcagacaacagggaagaaagagggaatgccaatcataaacaggaattataagaaaagcaacatcttctactgcgaacggtgtggcttccagagcatccatagccactgccaggaggagaacataaaagatagcaacgactttcactattcggtggaggaagtcgagcggatagaaatgaaaaacaaagaggccatcgaaaaatataagaagcaaggaaagaacttgcattttattaaaaatggggatgacaatgctgcgtacaatatcggagaaaagattagagaactccctaaaaagtctgacgtcaagaacacatcgatcagcggcaatatttcctttagctga

SEQ ID NO: 146 - DNA, 3831 bp, Unknown
  Metagenome-Derived Sequence
  misc_feature (1)..(3831): Unk38 Csm1 gene (plant codon-optimized)
atgaaaagctttgagaattcttgccagatatccaaaacactcaggttcggagcgaccctgaaggaggacaaaaagaagtgtaagtcccacgaggaacttcaggaattcgtggacatatcatataaaacaatgaagagctccgctacaatcgcggagagcttgaatgagatagaactcgtgaaaaaatgcgaaagatgttattccgagattatcaaatttcacgaagcatggggtcaaatttattgccggacggaccaaatagcggtgtataaggatttttacaggcaactcgcgaggaaagctcggtttgatgtcggcgaccagaattcgcagcttatcactttgtcatcgctttcttcaaaacataacgtgtatcagggcctcaaacggtctcagcacatcactaattactggaaggataacatagctaggcagaagtctttccttaaggatttttctcagcaactccatcagtacaagcgcgccctggagaactccgataaagcccacacgaagccgaacttgataaatttcaacaagacattctctatcttggccaatcttgttaacgaaattgttatcccacttagcaatggcgccatctcattcccaaatatttctaaactcgaggacggcgaggaatcccgccatctcatagagttcgctctcaacgattactcagatcttgtcggctcaattggagagttgaaagacgcgattgccaccaatggcggttacacgcctttcgcaaaggtcacattgaaccactataccgctgagcagaagccacatgtgtttaaaaacgacatcgacgccaagattcgcgagctcaaactgatagaactcgttgagaagctcaagaataaaacctccaaacagatagaggaatacttctctaaattcgacaagtttaagatttacgatgacaggaaccagtcagtgataattagaactcaatgcttcaaatacaaacctattcctttcttggtcaaacacgagctcgccaagtatatcgcggaggatgaggacgctgtgctcaaggtcctggatgcaatcggtgcgacacgctccccagcccatgactatgcacacaacgaggacgtgtttgatctgaagcattatccaattaaggtggcattcgactatgcttgggaacagctggcaaatggtgtctacacgactgtttcatttcccgaagagaaatgccgggaatatttgaacgcgatttatggctgcgaggtgacgaaagagcctgtttttaagttctacgctgacctcctttatatccggaagaacttggcagttctggaacataagaataatcttccaagcaacccggaggaattcatctgcaagatcgaaaatacgtttgaaaagattgtgctgccgtacaagattaaagaatttgagacctataagaaagccatcctcacctggatcaacgacggccgcggccacgagaagtacacggactcgaaacgggagctcgggctcattcgcggaggcttgaaaggcaggatcggcgcccagaagatgttcaggaagaataagaaaggggagctcataccatactacgaaaatccgtatacgaagttgactaacgagttcaagaacatatcttcttcttacggtaaaacattcgctgaactgagagacaagttcaaggaaaagagcgagatcacgaagatcacgcactttggcatcattattgaggacaataataaggaccggtatctgctggcgaacggtttgcagcatgacaacactgatcaatccaatacccaagttgaggcaatactcggaaaactgaacacctcccttgagttcacgacatatcaggtgaaaagcttgacgtcgaagatcctcatcaagcttatcaaaaaccatacaacctcaccgaacgcaaagtccccatacgctgacttccatacatccaagattcatgttgactggaccaaaatcaagaaagagtgggatacctacaagtcaaaccacagcttgcttcagtatgtcaaggactgccttactaattccaccatggcaaaaaatcagaactgggcagagttcggctgggacctggagtcatgtaattcctacgaggctattgagcatgagattgaccagaagtcatacatcttgcagaagcacactataagcaaggcctctataaagagcttggtggaaaacggttgtctcctgcttccgatagtgaatcaagacatcacatcgcaggggaggaaggacaagaaccagttctccaaggactggaagcagatctttgaggatagcaaggagtaccgccttcatccggagtttgccgtgtcgtataggacgcccattaaggactatccaaaagacaagcgctatggtcgccttcagttcatctgcgcctttaattgcgagattatcccccagaatggtgagtttatcaacctcaaaaagcagattgagaatttcaacgacgaggatattcaaaagaacaatgtggcagaattcaataacaaggtcaatgaagctttgctcggtaaggaatacgtggtcatcggtatcgatcggggtcttaagcagttggctaccctttgcgttctcaacaagcgcggcaaaatccttggagatttcgaaatctataagaaagagttcgtgagaacagaaaatagatctaaaaactattggaagcatacgctcgctgaaacaaggcacatcttggatctctcaaaccttagggttgaaaccactgttgaggataacaaggtcttggtcgaccagtcgttgacactcgtgaaaaagaatagggataccccggacgagaaggccaccgaggagaatcgccagaagatcaagctcaaacagctgtcgtacatacgcaagttgcaatacgcgatgcagactaacgaacaagcagttctcgacttgttgaaggataactctgacgacgaggagtttaaaaagagggtggagggggtgatttctccttttggggagggtcaggagtacgcggatctgccgattgataccatgagagccatgatccaggatctccagggcgtcatcgcaaaaggcaataagcaaacggaaaagaacaaaataatagagctggacgcagcggattcgttgaaacagggtgttgtggcgaacatgatcggcgtggttaactttattcttgccaagtttaattacgaggcatatgtgagcctcgaggacctgtcaagagcgtacaatgttgctaagtcgggctatgatggacgctatctcccgtcgacctcgcaagatccagatatggattttaaggagcagcagaaccagatgttggccggcctgggtacttatcaattctttgagatacaattgcttaaaaagcttcagaaaatccaatcaaacaacactgtcttgcgctttgtcccggcgttcaggtcagcggacaattatcgcaatatcataaaattgaacccaaagtatgataataccgagtacgtccacaagcccttcgggatagttcacttcatagacccgaaagacacttcgtctaaatgtccggtgtgcgggaaaacgggaaagaaaaacgtggacagaaatgagaaaaagaacaatatcttgctgtgtaaggcatgcgctttcaggacagtttgggagttcaaacaaccagaaaacatcaagaacgagaagcactgcttttctgaggatggcataaagaaaactgccgaggataacaacaagaagataaaggaaaagaatcttagcgataagaacctccactacatacacaatggcgatgacaacggcgcctatcatattgcactgaagtccgtggagaacctgaagcacaagaaatga

SEQ ID NO: 147 - protein, 1300 aa, Francisella novicida
  MISC_FEATURE (1)..(1300): FnCpf1
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 148 - protein, 1307 aa, Acidaminococcus sp. BV3L6
  MISC_FEATURE (1)..(1307): AsCpf1
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 149 - protein, 1228 aa, Lachnospiraceae bacterium ND2006
  MISC_FEATURE (1)..(1228): LbCpf1
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 150 - protein, 1129 aa, Alicyclobacillus acidoterrestris
  MISC_FEATURE (1)..(1129): AacC2c1
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 151 - protein, 986 aa, Deltaproteobacteria bacterium
  MISC_FEATURE (1)..(986): CasX
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 152 - protein, 1273 aa, Unknown
  Metagenome-Derived Sequence
  MISC_FEATURE (1)..(1273): C2c3_AUXO
MKKFELKQNFRNNYSGKTLRNFRQTLAQIANKKSSDSILTIKFKLDCSKTGKLPKYENLISLYDTIEDIKKGTLSYYLFTLIVSGFKFFGSASQAKAFSTKDIFKDNDFYNQFKIQSHLDLPDFVPSKIYQRLKKNVRSTNGKDNAFKASVIVAEYRKEIGKLKNKDESSEHQCEELFKKIGTALETRFSSWQDLINNCSTGCEIIDEILNDSFGTLPSIKKMVLASTTQSSDGEQDGIAIAYDPDSTFIKSDELLNPYFAVATILKSMPPEIQQDKKSAYVKANLTTPTHNALSWIFGKGLTLFQTESTEKLCAMFNVSDKRVIEQVQDAAKAVKLPAELDLNHCTLKFQDFRSSLGGHLDSWTTNYLKRLDELNDLLLNLPKNLSLPDIFMIDGKDFIEYSGCNRDEIQQMIDFVVNEQNRIKLQESLNALLGKGNNQICSDDISTVKDFSEIVNSLHSFVQQIDNSLEQSSNEANSIFSELKKKIEKNEKWDIWKNNLKKIPKLNKLSGGVPDAWKEIREIEQKFHEISENQKKHFTEVMEWIDAGNGTIDIFESRFKYDELLKKSKKNNLQSADELAFRSVLNKLGRFARQGNDLVCEKIKNWFKEQNIFDSSKDFNRYFINQKGFIFKHPSSKKDNSPYNLSANLLEKRYEVTNTVGALLEQCESDPAIVNDPFSMRSLVEFRALWFSINISGISKEQHIPTKIAQPKLDDSTYQESVSPTLKYRLEKEQITSSELNSIFTVYKSLLSGLSIRLSRNSFYLRTKFSWIGNNSLIYCPKETTWKIPAAYFKSDLWNEYKDKQILIVNEEYDVDVVKTFESVYKIVKSKDNNEKNRILPLLKQLPHDWMFKLPFGASNAEKCKVLKLEKNNKKFKPLSVSKDSLARLSGPSTYFNQIDEIMMNDESELSEMTLLADEPVRQQMSNGKIEIIPDDYVMSLAIPITRSLKKGNTESFPFKNIVSIDQGEAGFAYAVFKLSDCGNERAEPIATGLIPIPSIRRLIHSVKKYRGKKQRIQNFNQKFDSTMFTLRENVTGDICGLIVALMKKYNAFPILEKQVGNLESGSKQLMLVYKAVNSKFLAAKVDMQNDQRRSWWYQGNSWNTPILRISNPNQSNNKNIVKNINGKKYEELKIYPGYSVSAYMTSCICHVCGRNALELLKNDDSTGKVKKYQINQDGEVTIGGEVIKLYRKPDRLTPVKNLAKKGNRERTYASINERAPMSKDTTQSRYFCVFKNCPCHNKEQHADVNAAINIGRRFLKDCILDDNKEKD

SEQ ID NO: 153 - protein, 1125 aa, Unknown
  Metagenome-Derived Sequence
  MISC_FEATURE (1)..(1125): CasY.1
MRKKLFKGYILHNKRLVYTGKAAIRSIKYPLVAPNKTALNNLSEKIIYDYEHLFGPLNVASYARNSNRYSLVDFWIDSLRAGVIWQSKSTSLIDLISKLEGSKSPSEKIFEQIDFELKNKLDKEQFKDIILLNTGIRSSSNVRSLRGRFLKCFKEEFRDTEEVIACVDKWSKDLIVEGKSILVSKQFLYWEEEFGIKIFPHFKDNHDLPKLTFFVEPSLEFSPHLPLANCLERLKKFDISRESLLGLDNNFSAFSNYFNELFNLLSRGEIKKIVTAVLAVSKSWENEPELEKRLHFLSEKAKLLGYPKLTSSWADYRMIIGGKIKSWHSNYTEQLIKVREDLKKHQIALDKLQEDLKKVVDSSLREQIEAQREALLPLLDTMLKEKDFSDDLELYRFILSDFKSLLNGSYQRYIQTEEERKEDRDVTKKYKDLYSNLRNIPRFFGESKKEQFNKFINKSLPTIDVGLKILEDIRNALETVSVRKPPSITEEYVTKQLEKLSRKYKINAFNSNRFKQITEQVLRKYNNGELPKISEVFYRYPRESHVAIRILPVKISNPRKDISYLLDKYQISPDWKNSNPGEVVDLIEIYKLTLGWLLSCNKDFSMDFSSYDLKLFPEAASLIKNFGSCLSGYYLSKMIFNCITSEIKGMITLYTRDKFVVRYVTQMIGSNQKFPLLCLVGEKQTKNFSRNWGVLIEEKGDLGEEKNQEKCLIFKDKTDFAKAKEVEIFKNNIWRIRTSKYQIQFLNRLFKKTKEWDLMNLVLSEPSLVLEEEWGVSWDKDKLLPLLKKEKSCEERLYYSLPLNLVPATDYKEQSAEIEQRNTYLGLDVGEFGVAYAVVRIVRDRIELLSWGFLKDPALRKIRERVQDMKKKQVMAVFSSSSTAVARVREMAIHSLRNQIHSIALAYKAKIIYEISISNFETGGNRMAKIYRSIKVSDVYRESGADTLVSEMIWGKKNKQMGNHISSYATSYTCCNCARTPFELVIDNDKEYEKGGDEFIFNVGDEKKVRGFLQKSLLGKTIKGKEVLKSIKEYARPPIREVLLEGEDVEQLLKRRGNSYIYRCPFCGYKTDADIQAALNIACRGYISDNAKDAVKEGERKLDYILEVRKLWEKNGAVLRSAKFL

SEQ ID NO: 154 - protein, 1057 aa, Microgenomates (Roizmanbacteria) bacterium GW2011_GWA2_37_7
  MISC_FEATURE (1)..(1057): MicroCsm1
MEIQELKNLYEVKKTVRFELKPSKKKIFEGGDVIKLQKDFEKVQKFFLDIFVYKNEHTKLEFKKKREIKYTWLRTNTKNEFYNWRGKSDTGKNYALNKIGFLAEEILRWLNEWQELTKSLKDLTQREEHKQERKSDIAFVLRNFLKRQNLPFIKDFFNAVIDIQGKQGKESDDKIRKFREEIKEIEKNLNACSREYLPTQSNGVLLYKASFSYYTLNKTPKEYEDLKKEKESELSSVLLKEIYRRKRFNRTTNQKDTLFECTSDWLVKIKLGKDIYEWTLDEAYQKMKIWKANQKSNFIEAVAGDKLTHQNFRKQFPLFDASDEDFETFYRLTKALDKNPENAKKIAQKRGKFFNAPNETVQTKNYHELCELYKRIAVKRGKIIAEIKGIENEEVQSQLLTHWAVIAEERDKKFIVLIPRKNGGKLENHKNAHAFLQEKDRKEPNDIKVYHFKSLTLRSLEKLCFKEAKNTFAPEIKKETNPKIWFPTYKQEWNSTPERLIKFYKQVLQSNYAQTYLDLVDFGNLNTFLETHFTTLEEFESDLEKTCYTKVPVYFAKKELETFADEFEAEVFEITTRSISTESKRKENAHAEIWRDFWSRENEEENHITRLNPEVSVLYRDEIKEKSNTSRKNRKSNANNRFSDPRFTLATTITLNADKKKSNLAFKTVEDINIHIDNFNKKFSKNFSGEWVYGIDRGLKELATLNVVKFSDVKNVFGVSQPKEFAKIPIYKLRDEKAILKDENGLSLKNAKGEARKVIDNISDVLEEGKEPDSTLFEKREVSSIDLTRAKLIKGHIISNGDQKTYLKLKETSAKRRIFELFSTAKIDKSSQFHVRKTIELSGTKIYWLCEWQRQDSWRTEKVSLRNTLKGYLQNLDLKNRFENIETIEKINHLRDAITANMVGILSHLQNKLEMQGVIALENLDTVREQSNKKMIDEHFEQSNEHVSRRLEWALYCKFANTGEVPPQIKESIFLRDEFKVCQIGILNFIDVKGTSSNCPNCDQESRKTGSHFICNFQNNCIFSSKENRNLLEQNLHNSDDVAAFNIAKRGLEIVKV

SEQ ID NO: 155 - protein, 1067 aa, Omnitrophica WOR_2 bacterium GWF2_38_59
  MISC_FEATURE (1)..(1067): ObCsm1
MKNGINLFKTKTTKTKGVDMEKYQITKTIRFKLLPDNAHEIVEKVKSLKTSNVDELMDEVKNVHLKGLELLFALKKYFYFDGNQCKSFKSTLEIKARWLRLYTPDQYYLKKSSKNSYQLKSLSYFKDVFNDWLFNWEESVSELAIIYEKYKICQHQRDSRADIALLIKKLSMKEYFPFISDLIDCVNDKNSNKTFLMKLSEELSVLLEKCNSRALPYQSNGIVVGKASLNYYTVSKSEKMLQNEYEDVCQSLDKNYDITEMKVILYKEKLDNLNFKDVTIANAYNLLKENKALQKRLFSEYVSQGKVLSLIKTELPLFSNINDNDFEKYKEWSNEIKKLADKKNTFCKKTQQDKIKDIQNKISELKKKRGALFQYKFTSFQKHCDNYKKVAVQYGKLKARKKAIEKDEIEANLLRYWSVILEQEDKHSLVLIPKNNAKDAKQYIETINTKGGKYIIHHLDSLTLRALNKLCFNAVDIEKGQMVRENTFYQGIKEEFERNKINCDNQGVLKIQGLYSFKTEGGQINEKEAVEFFKEVLKSNYAREVLNLPYDLESNIFQKEYTNLDQFRQDLEKCCYALHSKIGKDDLDEFTRRFEAQVFDITSIDLKSKKEKTKTTGEMKKHTQLWLEFWKGAIEQNFATRVNPELSIFWRAPKSSREKKYGKGSDLYDPNKNNRYLYEQYTLALTITENAGSHFKDIAFKDTSKIKEAIKEFNMSLSQSKYCFGIDRGNAELVSLCLIKNEKDFPFEKFPVYRLRDLTYQGDFKDKHDQMRYGVAIKNISYFIDQEDLFEKNNLSAIDMTTAKLIKNKIVLNGDVLTYLKLKEETAKHKLTQFFQGSSINKNSRVYFDEDENVFKITTNRNHNPEEIIYFYRGEYGAIKNKNDLEDILNEYLCKMETGESEIVLLNRVNHLRDAISANIVGILSYLIDLFPETIVALENLAKGTIDRHVSQSYENITRRFEWALYRKLLNKQLAPPELKENILLREGDDKIDQFGIIHFVEEKNTSKDCPNCRKTTQQTNDNKFKEKKFVCKSCGFDTSKDRKGMDSLNSPDTVAAYNVARKKFES

SEQ ID NO: 156 - protein, 1084 aa, Smithella sp. SC_K08D17
  MISC_FEATURE (1)..(1084): Sm17Csm1
MEKYKITKTIRFKLLPDKIQDISRQVAVLQNSTNAEKKNNLLRLIQRGQELPKLLNEYIRYSDNHKLKSNVTVHFRWLRLFTKDLFYNWKKDNTEKKIKISDVDYLSRVFEDFFNEWETVIERINTDCNRPEESKTRDAEIAFSIKKIATKQMFPFIKSFVYNSNYKNSEETKSKLTALLNEFETVLKICEQNYLPSQSAGIVIAKASFNYYTINKKQKDYKGYTDDIEKIEKGMNSKFHYERKYDQLLEELNLIALKELPLIEFYSKIKSYKSTRKIEFSEAVSKGLAFADLKSKFPLFQTESNKYAEFLELTGRITQISTAKSLLSKDNPEAQKLRDEIKKLRINRGEYFKNNFHKYISLCNLYKKIADKKGRLKGQVKGIENERIDSQRIQHWALVLEDNLKHSLILIPKEKVTEVYRKVRASKADSTSSSSSLYYFESMTYRALHKLCFGVNGNTFLPEIQKELPEYNPNKQSDFGEFCFHKSNTDKEIDEPKLISFYQSVLKTNYVKDNLNLPQSVFDEATVQTFETRQDFQIALEKCCYAKKTIISETLKKEILEDNNVQIFQITSLDLQRSEQKNLKAHTKIWNRFWTKQNETANYDLRLNPETAIVWRKPKKTRIDKYGAGTSLYDPKKRNRYLHEQYTLCTTVTDNALNNEITFAFEDTKKKGTEIVKYNEKINQTLKKEFNKNQLWFYGIDAGEIELATLALMNKDKEPQLFTVYELKKSDFFKHGYIYNKERELVIREKPYKAIQNLSYFLNEELYEKTFRDGKFQETFNELFKEKHVSAIDLTTAKVINGKIILNGDMITFLNLRILHAKRKIYEELIINPQAELKENEKEYYLYFDKEGTEKVEKIYRSRLDFEHIKPYQEIRNDLNAYFKNVQKNEAKVEDQINQTRRALVGNMIGVIYYLYQKYRGIISIEDLKQTKVESDRNKFEGNIERPLEWALYRKFQQEGYVPPISELIKLRELEKFPLKDVKQPKYENIQQFGIIKFVSPEETSTTCPSCEKKAYELQKEKKGEEKPAENKRYEADKKAGVFCCPKCGFHNRTNPMGYESLDSNDKVAAFNIAKRGFEQNFRQ

SEQ ID NO: 157 - protein, 872 aa, Alicyclobacillus contaminans
  MISC_FEATURE (1)..(872): AcoC2c1
MGFNTAELLRKVEEEMRKTSVGFDTDNPFAHRITRRAIRGWDRIAEAWRRLPPDAPESEYIEAFKDIQRKNPRKIGSEPLFKNLAAPGVRSELLNNPQVLITFAKYNELQRQLAKAKQFAQKTLPHPVFHPVWVRYDKLGGNLHHYQIEPAVHANDTHKVKFSSLLLPQEDGSYAEVKDVTVSLAPSLQFPTGLVHPKVTTPPRTGLVTVMDEEAGKPVVCYRDRGHDALVPVAFGGAKLQFNRAHLSAGYRKGVLSAGGGGSIYFNVTLDVQVPNERDVSKTFSFSRDRDLVSLKAEELKRYMETKPLGMPGVRVMSVDLGVRYGAAISVFEVKPFAEVRKDKLHYPITGCEGFVAEHERSVILKLPGEGVRTAGKQSERKQALAAIRAEMSILRKWLRVSQVTEEDRAKAVRGLLEDERGGGWTMDPGEDSDHQPLQQFLHEARLAVGELVNLVHLSPAEWERAVIERHRRLERITASHIRVFQTMRKVWGKRRNEDAAHTGGISLAHIEHLIQQRKLFIRWSTHARTYGEVRRLPKHEGFAKRLQKHTNHVKEDRIKKLADMIVMAARGYRFLDKRARWVKTRHAPCDLILFEDLSRYRFTMDRPPTENSQLMNWSHRELLKTVKMQAALFGIGVGTVPAAFTSRFDAQTGAPGLRCKRVTKQDKEKTPFWLIQFAEITGVNVTNVEPGQLIPVDGGEWFVSPKGPRAADGLKCVHADINAAHNLQRRFWIPRLPSVKCRRYVEAEGFAAVPSSTAFMKVHGKGAFVSVDGEFYEYQKGRRVAVNRADRTSSTLDEDEGDIGEEMLVSSNGAGEFVRMFYDESGYVGYGRWMDSKVFWGKVRQIVHRAIQDQVEKRAAARGENGATSSR

SEQ ID NO: 158 - protein, 1149 aa, Desulfovibrio inopinatus
  MISC_FEATURE (1)..(1149): DiC2c1
MPTRTINLKLVLGKNPENATLRRALFSTHRLVNQATKRIEEFLLLCRGEAYRTVDNEGKEAEIPRHAVQEEALAFAKAAQRHNGCISTYEDQEILDVLRQLYERLVPSVNENNEAGDAQAANAWVSPLMSAESEGGLSVYDKVLDPPPVWMKLKEEKAPGWEAASQIWIQSDEGQSLLNKPGSPPRWIRKLRSGQPWQDDFVSDQKKKQDELTKGNAPLIKQLKEMGLLPLVNPFFRHLLDPEGKGVSPWDRLAVRAAVAHFISWESWNHRTRAEYNSLKLRRDEFEAASDEFKDDFTLLRQYEAKRHSTLKSIALADDSNPYRIGVRSLRAWNRVREEWIDKGATEEQRVTILSKLQTQLRGKFGDPDLFNWLAQDRHVHLWSPRDSVTPLVRINAVDKVLRRRKPYALMTFAHPRFHPRWILYEAPGGSNLRQYALDCTENALHITLPLLVDDAHGTWIEKKIRVPLAPSGQIQDLTLEKLEKKKNRLYYRSGFQQFAGLAGGAEVLFHRPYMEHDERSEESLLERPGAVWFKLTLDVATQAPPNWLDGKGRVRTPPEVHHFKTALSNKSKHTRTLQPGLRVLSVDLGMRTFASCSVFELIEGKPETGRAFPVADERSMDSPNKLWAKHERSFKLTLPGETPSRKEEEERSIARAEIYALKRDIQRLKSLLRLGEEDNDNRRDALLEQFFKGWGEEDVVPGQAFPRSLFQGLGAAPFRSTPELWRQHCQTYYDKAEACLAKHISDWRKRTRPRPTSREMWYKTRSYHGGKSIWMLEYLDAVRKLLLSWSLRGRTYGAINRQDTARFGSLASRLLHHINSLKEDRIKTGADSIVQAARGYIPLPHGKGWEQRYEPCQLILFEDLARYRFRVDRPRRENSQLMQWNHRAIVAETTMQAELYGQIVENTAAGFSSRFHAATGAPGVRCRFLLERDFDNDLPKPYLLRELSWMLGNTKVESEEEKLRLLSEKIRPGSLVPWDGGEQFATLHPKRQTLCVIHADMNAAQNLQRRFFGRCGEAFRLVCQPHGDDVLRLASTPGARLLGALQQLENGQGAFELVRDMGSTSQMNRFVMKSLGKKKIKPLQDNNGDDELEDVLSVLPEEDDTGRITVFRDSSGIFFPCNVWIPAKQFWPAVRAMIWKVMASHSLG

SEQ ID NO: 159 - protein, 1194 aa, Desulfonatronum thiodismutans
  MISC_FEATURE (1)..(1194): DtC2c1
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 160 - protein, 1388 aa, Opitutaceae bacterium TAV5
  MISC_FEATURE (1)..(1388): ObC2c1
MSLNRIYQGRVAAVETGTALAKGNVEWMPAAGGDEVLWQHHELFQAAINYYLVALLALADKNNPVLGPLISQMDNPQSPYHVWGSFRRQGRQRTGLSQAVAPYITPGNNAPTLDEVFRSILAGNPTDRATLDAALMQLLKACDGAGAIQQEGRSYWPKFCDPDSTANFAGDPAMLRREQHRLLLPQVLHDPAITHDSPALGSFDTYSIATPDTRTPQLTGPKARARLEQAITLWRVRLPESAADFDRLASSLKKIPDDDSRLNLQGYVGSSAKGEVQARLFALLLFRHLERSSFTLGLLRSATPPPKNAETPPPAGVPLPAASAADPVRIARGKRSFVFRAFTSLPCWHGGDNIHPTWKSFDIAAFKYALTVINQIEEKTKERQKECAELETDFDYMHGRLAKIPVKYTTGEAEPPPILANDLRIPLLRELLQNIKVDTALTDGEAVSYGLQRRTIRGFRELRRIWRGHAPAGTVFSSELKEKLAGELRQFQTDNSTTIGSVQLFNELIQNPKYWPIWQAPDVETARQWADAGFADDPLAALVQEAELQEDIDALKAPVKLTPADPEYSRRQYDFNAVSKFGAGSRSANRHEPGQTERGHNTFTTEIAARNAADGNRWRATHVRIHYSAPRLLRDGLRRPDTDGNEALEAVPWLQPMMEALAPLPTLPQDLTGMPVFLMPDVTLSGERRILLNLPVTLEPAALVEQLGNAGRWQNQFFGSREDPFALRWPADGAVKTAKGKTHIPWHQDRDHFTVLGVDLGTRDAGALALLNVTAQKPAKPVHRIIGEADGRTWYASLADARMIRLPGEDARLFVRGKLVQEPYGERGRNASLLEWEDARNIILRLGQNPDELLGADPRRHSYPEINDKLLVALRRAQARLARLQNRSWRLRDLAESDKALDEIHAERAGEKPSPLPPLARDDAIKSTDEALLSQRDIIRRSFVQIANLILPLRGRRWEWRPHVEVPDCHILAQSDPGTDDTKRLVAGQRGISHERIEQIEELRRRCQSLNRALRHKPGERPVLGRPAKGEEIADPCPALLEKINRLRDQRVDQTAHAILAAALGVRLRAPSKDRAERRHRDIHGEYERFRAPADFVVIENLSRYLSSQDRARSENTRLMQWCHRQIVQKLRQLCETYGIPVLAVPAAYSSRFSSRDGSAGFRAVHLTPDHRHRMPWSRILARLKAHEEDGKRLEKTVLDEARAVRGLFDRLDRFNAGHVPGKPWRTLLAPLPGGPVFVPLGDATPMQADLNAAINIALRGIAAPDRHDIHHRLRAENKKRILSLRLGTQREKARWPGGAPAVTLSTPNNGASPEDSDALPERVSNLFVDIAGVANFERVTIEGVSQKFATGRGLWASVKQRAWNRVARLNETVTDNNRNEEEDDIPM

SEQ ID NO: 161 - protein, 1132 aa, Tuberibacillus calidus
  MISC_FEATURE (1)..(1132): TcC2c1
MATKSFILKMKTKNNPQLRLSLWKTHELFNFGVAYYMDLLSLFRQKDLYMHNDEDPDHPVVLKKEEIQERLWMKVRETQQKNGFHGEVSKDEVLETLRALYEELVPSAVGKSGEANQISNKYLYPLTDPASQSGKGTANSGRKPRWKKLKEAGDPSWKDAYEKWEKERQEDPKLKILAALQSFGLIPLFRPFTENDHKAVISVKWMPKSKNQSVRKFDKDMFNQAIERFLSWESWNEKVAEDYEKTVSIYESLQKELKGISTKAFEIMERVEKAYEAHLREITFSNSTYRIGNRAIRGWTEIVKKWMKLDPSAPQGNYLDVVKDYQRRHPRESGDFKLFELLSRPENQAAWREYPEFLPLYVKYRHAEQRMKTAKKQATFTLCDPIRHPLWVRYEERSGTNLNKYRLIMNEKEKVVQFDRLICLNADGHYEEQEDVTVPLAPSQQFDDQIKFSSEDTGKGKHNFSYYHKGINYELKGTLGGARIQFDREHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMISKVLYSPHSVWVDQLKSIHRKLEEQLGKEISKWRQSISQGRQGVYGISLKNIEDIEKTRRLLFRWSMRPENPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGGQKVRNQKFLDSLVENNIIEPDDARRLEPGDLIRDQGGDKFATLDERGELVITHADINAAQNLQKRFWTRTHGLYRIRCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLFDGGSSRRGLFNGTDSNTNVE

SEQ ID NO: 162 - protein, 1108 aa, Bacillus thermoamylovorans
  MISC_FEATURE (1)..(1108): BtC2c1
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 163 - protein, 864 aa, Brevibacillus sp. CF112
  MISC_FEATURE (1)..(864): BspC2c1
MPKILRGHKWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHHRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRSRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 164 - protein, 1489 aa, Desulfatirhabdium butyrativorans
  MISC_FEATURE (1)..(1489): DbC2c1
MPLSNNPPVTQRAYTLRLRGADPSDLSWREALWHTHEAVNKGAKVFGDWLLTLRGGLDHTLADTKVKGGKGKPDRDPTPEERKARRILLALSWLSVESKLGAPSSYIVASGDEPAKDRNDNVVSALEEILQSRKVAKSEIDDWKRDCSASLSAAIRDDAVWVNRSKVFDEAVKSVGSSLTREEAWDMLERFFGSRDAYLTPMKDPEDKSSETEQEDKAKDLVQKAGQWLSSRYGTSEGADFCRMSDIYGKIAAWADNASQGGSSTVDDLVSELRQHFDTKESKATNGLDWIIGLSSYTGHTPNPVHELLRQNTSLNKSHLDDLKKKANTRAESCKSKIGSKGQRPYSDAILNDVESVCGFTYRVDKDGQPVSVADYSKYDVDYKWGTARHYIFAVMLDHAARRISLAHKWIKRAEAERHKFEEDAKRIANVPARAREWLDSFCKERSVTSGAVEPYRIRRRAVDGWKEVVAAWSKSDCKSTEDRIAAARALQDDSEIDKFGDIQLFEALAEDDALCVWHKDGEATNEPDFQPLIDYSLAIEAEFKKRQFKVPAYRHPDELLHPVFCDFGKSRWKINYDVHKNVQAPFYRGLCLTLWTGSEIKPVPLCWQSKRLTRDLALGNNHRNDAASAVTRADRLGRAASNVTKSDMVNITGLFEQADWNGRLQAPRQQLEAIAVVRDNPRLSEQERNLRMCGMIEHIRWLVTFSVKLQPQGPWCAYAEQHGLNTNPQYWPHADTNRDRKVHARLILPRLPGLRVLSVDLGHRYAAACAVWEAVNTETVKEACQNVGRDMPKEHDLYLHIKVKKQGIGKQTEVDKTTIYRRIGADTLPDGRPHPAPWARLDRQFLIKLQGEEKDAREASNEEIWALHQMECKLDRTKPLIDRLIASGWGLLKRQMARLDALKELGWIPAPDSSENLSREDGEAKDYRESLAVDDLMFSAVRTLRLALQRHGNRARIAYYLISEVKIRPGGIQEKLDENGRIDLLQDALALWHELFSSPGWRDEAAKQLWDSRIATLAGYKAPEENGDNVSDVAYRKKQQVYREQLRNVAKTLSGDVITCKELSDAWKERWEDEDQRWKKLLRWFKDWVLPSGTQANNATIRNVGGLSLSRLATITEFRRKVQVGFFTRLRPDGTRHEIGEQFGQKTLDALELLREQRVKQLASRIAEAALGIGSEGGKGWDGGKRPRQRINDSRFAPCHAVVIENLANYRPDETRTRLENRRLMTWSASKVHKYLSEACQLNGLYLCTVSAWYTSRQDSRTGAPGIRCQDVSVREFMQSPFWRKQVKQAEAKHDENKGDARERFLCELNKTWKAKTPAEWKKAGFVRIPLRGGEIFVSADSKSPSAKGIHADLNAAANIGLRALTDPDWPGKWWYVPCDPVSFESKMDYVKGCAAVKVGQPLRQPAQTNADGAASKIRKGKKNRTAGTSKEKVYLWRDISAFPLESNEIGEWKETSAYQNDVQYRVIRMLKEHIKSLDNRTGDNVEG

SEQ ID NO: 165 - protein, 978 aa, Planctomycetes bacterium
  MISC_FEATURE (1)..(978): CasX
MQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 166 - protein, 1255 aa, Unknown
  Metagenome-Derived Sequence
  MISC_FEATURE (1)..(1255): C2c3_CEPX
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGSVLHRYTFSGVDAHKAKRREYWYNGELWEHPYLMAKKWNEETNSMSGAPKPVSLFPGVTVNAARTSQICHQCQRNPMSHLRGLTGTIEISSDGLLELDDGTIRLFETSDYDEDKFKQSRREKRRLDANVLLSGRHRAEYIYTVAKRNLRRPPKNVMTKDTTQSRYTCLYKNCSWTGHADENAAINIGRRYLAERIDMPASKTKAAV

SEQ ID NO: 167 - protein, 1258 aa, Unknown
  Metagenome-Derived Sequence
  MISC_FEATURE (1)..(1258): C2c3_CEVA
MNARDWRKHVGVLAQQHKETTRTYTFPLDTTGSAIDFDAALQAYNAVEGVGYGSLLGLACAVHLSGFRLFSTGKEAATFRNRARYPNAAFQAALRKELGTTITTLTPETLDRLFSSRPKRRNGVPLPWNQDSIRDRLYTNWVKPRPGDTPDAVLFQIATGIAQEITEDVSSWTDLAKNSDRGLKAAHRYFARVGGFPAFDNLTPPATVQPTDTTIDYDPNAPFHLVSHADQTLIHQSISLCAHRIRQEDPALDPNKSGFIKQLQNNFLSQTFYGLSWLFGAGYVHFRECTANDLAIQYGIPNNCRDGIHQIKSFADAILPNTFFEKKHYRKDSRSVGKKAKSWISNYWQRLLQLQTWVDDHTWVTLPQELTEAQFKPLFRGLLVDAVELMAIAERLPQRLADCRDSLDCLMGKGPQAATKNDVEIVEKVREEIESFVGQIEQLGNQLRHQLENENNDQVHRDNLHQLKNRLPLDLRRPQALNKISGGVPDVAKSIRGLETQLDQVLKERRSHFGRLTKWAKECGITLDPLQPLIESEKQRVAERGSAHDAKELAIRLLLQRIGRLGHRLSPTNATAIQELLRPVFAVKREFNLFFHNHMGALYRSPYSTSRHQPFQINVDVAHGTDWIGTIETLIQNLFTQIQDDALLRDLVQLEGFVFSHKLRALPGVIPSELARPNNLQQMGLPALLLVLLQADQVHRETVLRVFNLYGSAINGYLFQALRPGFIVRAGFQRLETKKLRYVPKAQSWQYPDRLHHAKSAIKNSLSAGWIKKNHQGAILPQKTLTALVKQKSLKDTGVPEYLVQAPHDWYVPIDLRGPAIPIEGLTVGTEGPELTQLGPMKDDCAFRAIGPSSFKSKIDAGLLPQDVKYGDMTLIFDQHYQQSISFANGTFSIQYQPTSLQVKAAIPVVDKRPRDTRNNSHLYDRIVAIDLGERKIGYAIFDLKQVLKSEQLEPMREDGKPLIGSISIRSIRGLMKAVQTHRNRRQPNYRIDQTYSKALMHYRESVIGDVCNAIDTLCARYGGFPVLESSVRNFEVGSAQLKTVYGSVSRRYTWSAVDAHKNQRQQYWLGGTKDKIPIWTHPYLMTREWDEKNSKWSNRSKPLKMHPGVEVHPAGTSQICHQCKRNPIGALWNVADTVVLDDQGQLDLDDGTIRLNSGYIDTTEIKRARRKKIRLPENKPLTGSHKTSHVRAVARRNLRQPPKSTRAKDTTQSRYTCLYVDCGHECHADENAAINIGRKYLQERIHIEASRQALSTR

SEQ ID NO: 168 - protein, 1269 aa, Unknown
  Metagenome-Derived Sequence
  MISC_FEATURE (1)..(1269): C2c3_CEPS
MVAGLKKIKRDGVTMKSNYHGGVKARAWRKRIGGLARRQKETVFTYKFPLETEEAGIDFDKAVQTYGIAEGISQGSLIGLVCAFHLSGFRLFSKADETKAFCNQGRYPNQAFAEKLRNELSVTLPKLSPQSLDVLFQSSPKSKNGVAPEWSKNAIRNRLYTNWTGKGAGTNPDEHLLEIAEDIAAEIDSDLDGWKDLEEHPEKGLSAADRYFQAQGDFPSLTGLPPSVPLTPQNSTVAFEGDPVCLNPSDNTLLHQAVARCAGRILQEQPNLSPDKNRFINQLQDELVSSQNNGLSWLFGVGFKYWKEMSVDQLADDYKVKSTDLDALKQVKSFIDAIPLNPLFDTPHYGEFRASVAGKMRSWVKNYWKRLLDLKSQLGTANINLPEGLDEQRAENLFSGLLIDSKGLRQVTDKLPSRLKKAEDTIDRLMGDGNPTSDDIEQVETVAAEISAFIGQVEQFNNQLEQRLENPLEGDDETFLKQLKIDLPAEFKKPPAINRISGGSPDPTAEIAELEEKLDRLMSARKEHYETIAEWASANKVTLDPMEAMTTLEAQRLTERGAEGDQEEFALRLLLQRIGRLANRLSPQGATAIRDLLRPVFTEKREFNLFFHNRMGSLYRSPYSTSRHQPFTIDVAVAKNTDWMDALDGIAETIMKGLSQAGDELSLRLRDWINISGFSLSQRLRGLPDTVPGELALVRSADDVRIPPMLALQLEEDEVSREVCLKAFNLYVSAINGCLFRALREGFIVRTKFQRLERDVLSYVPKTKLWNYPQRLDTARGPIHSALAAAWINKEGSVIDPVETVTALSDTGFSDDGIPEYLVQAPHDWYTPIDLRDISKPVSGLPVKKNITGLKRQKKQTAFRMVGPSSFKSHLDSTLLSEEVKLGDFTLIFDQYYKQRVSYNGRVKITFEPDRLHVEAAVPVIDKRVRPSTEEDALFDHLLAIDLGEKRVGYAVYDIKACLRTGDIKPLEDGDGKPIVGSVAVPSIRRLMKAVRSHRQQRQPNQKVNQTYSTALMNYRENVIGDVCNRIDTLMEKYNAFPVLESSVMNFEAGSRQLEMVYGSVLHRYTYSKIDAHTAKRKEYWYTGEYWDHPYLMAHKWNERTRSYSGSLSALTLYPGVMVHPAGTSQRCHQCKRNPMVEIKQLTGQVEINADGSLELDDGTICLYEGYDYSPEEYKKAKREKRRLDPNVPLSGRHQAKHVSAVAKRNLRRPTVSMMSGDTTQARYVCLYTDCDFTGHADENAAINIGWKYLTERIALSESKDKAGV

SEQ ID NO: 169 - protein, 1210 aa, Candidatus Parcubacteria
  MISC_FEATURE (1)..(1210): CasY.4
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 170 - protein, 1287 aa, Candidatus Kerfeldbacteria
  MISC_FEATURE (1)..(1287): CasY.6
MKRILNSLKVAALRLLFRGKGSELVKTVKYPLVSPVQGAVEELAEAIRHDNLHLFGQKEIVDLMEKDEGTQVYSVVDFWLDTLRLGMFFSPSANALKITLGKFNSDQVSPFRKVLEQSPFFLAGRLKVEPAERILSVEIRKIGKRENRVENYAADVETCFIGQLSSDEKQSIQKLANDIWDSKDHEEQRMLKADFFAIPLIKDPKAVTEEDPENETAGKQKPLELCVCLVPELYTRGFGSIADFLVQRLTLLRDKMSTDTAEDCLEYVGIEEEKGNGMNSLLGTFLKNLQGDGFEQIFQFMLGSYVGWQGKEDVLRERLDLLAEKVKRLPKPKFAGEWSGHRMFLHGQLKSWSSNFFRLFNETRELLESIKSDIQHATMLISYVEEKGGYHPQLLSQYRKLMEQLPALRTKVLDPEIEMTHMSEAVRSYIMIHKSVAGFLPDLLESLDRDKDREFLLSIFPRIPKIDKKTKEIVAWELPGEPEEGYLFTANNLFRNFLENPKHVPRFMAERIPEDWTRLRSAPVWFDGMVKQWQKVVNQLVESPGALYQFNESFLRQRLQAMLTVYKRDLQTEKFLKLLADVCRPLVDFFGLGGNDIIFKSCQDPRKQWQTVIPLSVPADVYTACEGLAIRLRETLGFEWKNLKGHEREDFLRLHQLLGNLLFWIRDAKLVVKLEDWMNNPCVQEYVEARKAIDLPLEIFGFEVPIFLNGYLFSELRQLELLLRRKSVMTSYSVKTTGSPNRLFQLVYLPLNPSDPEKKNSNNFQERLDTPTGLSRRFLDLTLDAFAGKLLTDPVTQELKTMAGFYDHLFGFKLPCKLAAMSNHPGSSSKMVVLAKPKKGVASNIGFEPIPDPAHPVFRVRSSWPELKYLEGLLYLPEDTPLTIELAETSVSCQSVSSVAFDLKNLTTILGRVGEFRVTADQPFKLTPIIPEKEESFIGKTYLGLDAGERSGVGFAIVTVDGDGYEVQRLGVHEDTQLMALQQVASKSLKEPVFQPLRKGTFRQQERIRKSLRGCYWNFYHALMIKYRAKVVHEESVGSSGLVGQWLRAFQKDLKKADVLPKKGGKNGVDKKKRESSAQDTLWGGAFSKKEEQQIAFEVQAAGSSQFCLKCGWWFQLGMREVNRVQESGVVLDWNRSIVTFLIESSGEKVYGFSPQQLEKGFRPDIETFKKMVRDFMRPPMFDRKGRPAAAYERFVLGRRHRRYRFDKVFEERFGRSALFICPRVGCGNFDHSSEQSAVVLALIGYIADKEGMSGKKLVYVRLAELMAEWKLKKLERSRVEEQSSAQ

SEQ ID NO: 171 - protein, 1192 aa, Candidatus Komeilibacteria
  MISC_FEATURE (1)..(1192): CasY.5
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDRGVAEKIEQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPAGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWSTYWEKRKPEDILGISTQVYWTGGIGESCPAVAVALLGHIRATSTQTEWEKEEVVFGRLKKFFPS

SEQ ID NO: 172 - protein, 1226 aa, Candidatus Vogelbacteria
  MISC_FEATURE (1)..(1226): CasY.2
MQKVRKTLSEVHKNPYGTKVRNAKTGYSLQIERLSYTGKEGMRSFKIPLENKNKEVFDEFVKKIRNDYISQVGLLNLSDWYEHYQEKQEHYSLADFWLDSLRAGVIFAHKETEIKNLISKIRGDKSIVDKFNASIKKKHADLYALVDIKALYDFLTSDARRGLKTEEEFFNSKRNTLFPKFRKKDNKAVDLWVKKFIGLDNKDKLNFTKKFIGFDPNPQIKYDHTFFFHQDINFDLERITTPKELISTYKKFLGKNKDLYGSDETTEDQLKMVLGFHNNHGAFSKYFNASLEAFRGRDNSLVEQIINNSPYWNSHRKELEKRIIFLQVQSKKIKETELGKPHEYLASFGGKFESWVSNYLRQEEEVKRQLFGYEENKKGQKKFIVGNKQELDKIIRGTDEYEIKAISKETIGLTQKCLKLLEQLKDSVDDYTLSLYRQLIVELRIRLNVEFQETYPELIGKSEKDKEKDAKNKRADKRYPQIFKDIKLIPNFLGETKQMVYKKFIRSADILYEGINFIDQIDKQITQNLLPCFKNDKERIEFTEKQFETLRRKYYLMNSSRFHHVIEGIINNRKLIEMKKRENSELKTFSDSKFVLSKLFLKKGKKYENEVYYTFYINPKARDQRRIKIVLDINGNNSVGILQDLVQKLKPKWDDIIKKNDMGELIDAIEIEKVRLGILIALYCEHKFKIKKELLSLDLFASAYQYLELEDDPEELSGTNLGRFLQSLVCSEIKGAINKISRTEYIERYTVQPMNTEKNYPLLINKEGKATWHIAAKDDLSKKKGGGTVAMNQKIGKNFFGKQDYKTVFMLQDKRFDLLTSKYHLQFLSKTLDTGGGSWWKNKNIDLNLSSYSFIFEQKVKVEWDLTNLDHPIKIKPSENSDDRRLFVSIPFVIKPKQTKRKDLQTRVNYMGIDIGEYGLAWTIINIDLKNKKINKISKQGFIYEPLTHKVRDYVATIKDNQVRGTFGMPDTKLARLRENAITSLRNQVHDIAMRYDAKPVYEFEISNFETGSNKVKVIYDSVKRADIGRGQNNTEADNTEVNLVWGKTSKQFGSQIGAYATSYICSFCGYSPYYEFENSKSGDEEGARDNLYQMKKLSRPSLEDFLQGNPVYKTFRDFDKYKNDQRLQKTGDKDGEWKTHRGNTAIYACQKCRHISDADIQASYWIALKQVVRDFYKDKEMDGDLIQGDNKDKRKVNELNRLIGVHKDVPIINKNLITSLDINLL

SEQ ID NO: 173 - protein, 1200 aa, Candidatus Vogelbacteria
  MISC_FEATURE (1)..(1200): CasY.3
MKAKKSFYNQKRKFGKRGYRLHDERIAYSGGIGSMRSIKYELKDSYGIAGLRNRIADATISDNKWLYGNINLNDYLEWRSSKTDKQIEDGDRESSLLGFWLEALRLGFVFSKQSHAPNDFNETALQDLFETLDDDLKHVLDRKKWCDFIKIGTPKTNDQGRLKKQIKNLLKGNKREEIEKTLNESDDELKEKINRIADVFAKNKSDKYTIFKLDKPNTEKYPRINDVQVAFFCHPDFEEITERDRTKTLDLIINRFNKRYEITENKKDDKTSNRMALYSLNQGYIPRVLNDLFLFVKDNEDDFSQFLSDLENFFSFSNEQIKIIKERLKKLKKYAEPIPGKPQLADKWDDYASDFGGKLESWYSNRIEKLKKIPESVSDLRNNLEKIRNVLKKQNNASKILELSQKIIEYIRDYGVSFEKPEIIKFSWINKTKDGQKKVFYVAKMADREFIEKLDLWMADLRSQLNEYNQDNKVSFKKKGKKIEELGVLDFALNKAKKNKSTKNENGWQQKLSESIQSAPLFFGEGNRVRNEEVYNLKDLLFSEIKNVENILMSSEAEDLKNIKIEYKEDGAKKGNYVLNVLARFYARFNEDGYGGWNKVKTVLENIAREAGTDFSKYGNNNNRNAGRFYLNGRERQVFTLIKFEKSITVEKILELVKLPSLLDEAYRDLVNENKNHKLRDVIQLSKTIMALVLSHSDKEKQIGGNYIHSKLSGYNALISKRDFISRYSVQTTNGTQCKLAIGKGKSKKGNEIDRYFYAFQFFKNDDSKINLKVIKNNSHKNIDFNDNENKINALQVYSSNYQIQFLDWFFEKHQGKKTSLEVGGSFTIAEKSLTIDWSGSNPRVGFKRSDTEEKRVFVSQPFTLIPDDEDKERRKERMIKTKNRFIGIDIGEYGLAWSLIEVDNGDKNNRGIRQLESGFITDNQQQVLKKNVKSWRQNQIRQTFTSPDTKIARLRESLIGSYKNQLESLMVAKKANLSFEYEVSGFEVGGKRVAKIYDSIKRGSVRKKDNNSQNDQSWGKKGINEWSFETTAAGTSQFCTHCKRWSSLAIVDIEEYELKDYNDNLFKVKINDGEVRLLGKKGWRSGEKIKGKELFGPVKDAMRPNVDGLGMKIVKRKYLKLDLRDWVSRYGNMAIFICPYVDCHHISHADKQAAFNIAVRGYLKSVNPDRAIKHGDKGLSRDFLCQEEGKLNFEQIGLL

SEQ ID NO: 174 - DNA, 3516 bp, Unknown
  Metagenome-Derived Sequence
  misc_feature (1)..(3516): Unk39 Csm1 gene (plant codon-optimized)
atgaacaacataaagaccacaaaagcgatccgctttaagctcgagaacagcgcgtccaacagggagatccaggagcggatcgacaatctctcatctaataatggttttgatctcgtctcgttcgtcacagaacttaataactacattgatcttcttaacggatacctcttttgttctaggggcgatcggttctatctcaacgacaagttcattctcaagaaggaatggatgaagaactatgccaagcaagaattcgcggagtttaaaacaaagattgacaacacggcaaatggagtccgggtgcagtatacggtgggagactaccgcgtcgaatctaagattcaggcagctttcgataatattgatgaaatctacggggagttgtgcgacgacgcgtcgagggagctcaacgagcggtctaaaagaacgagaaccgctctgctcctgaagcgcctctacgctaagaataaccttccgctgttgattgatttcgtggaaaattcgacgtataaaaaggaggttggaaatgattctttggttcttaaatccatgggaaagaggctgatggagcacttggagctgggtatacaagaatacttgccagagcaatctgccggcgtctcaatagccaaagcgagcttcaactactacacgatcaacaagaaaccaatagactacgacgccaagatcgaagagatcgaaaagaagcttgtggtgtccaacatagataggacctggaacgatagggataacaagattaaaaataacggcagactttggaacatcgttaaggcggacatcgcctccaggcagaataataagcctctctgtatcggagactctccatttatggacgtggacgaatacgcatccctgcgccagattatgaagaatattctcagcgagcaaaaggccgccttcaatgagcttatgcagcaggggggctcatataaggaactccagaataccgatctgtatctcttcaaagatatcacaaaggacgagttcgacaagtacagcgaattgacagaggacatagaggagcttgcgacgaagaggaaccagactaaaaacgaacaaaaaaagaaggagctcaagtcacaaatcgagaggcttagcaaacagcgcggtagcttcatttcagaagccgataaaacgactgagaagatgttcaagacctacaaagcgttcagcgttctgtacaagaaaattgcgcaaaagcacggcaaggagctcgcgaagcttaaaggcatcgagaaggaaaaagcagagagccaaactttgcagtactgggcgatgatcttggagaaggataataggcacaagcttgttctcgtcccaaaggccaaggcgaacgagtgtaggtcgaggctggtggaggcagataatgcgaatggagtcataaagttgtactggtttgaatcgttcacgtatagatcccttcagaagttgtgctttggcaatatagaaaacggttcaaatacattctatccgcagattagaagggatagggagttgggtcgcaaatactcaagccttgaccgcaatgggtacccaaagtttatatctggtgaacatgagttcgcaggcgacgagcagcggaagatccagttctatcaagatgtcctgaggaccgattacgccaggaaaaatcttaacctcccgtacggtaaggtcgaggagcgcatcattaacagcaccttcgagtctctggatgactttaaaatagccctggagtctatctgttacagaagagcagtgtgcacaaacatccacctgattgacgcgctcgagagcgagtacggtgcacagatatttgatatcacaagcttggacctccgcagggaagataacatcaaggacaaagaagagaagtacagctatagctacaaatcgcatacagcagtgtggaaggagttctggaccgcggaaaacgagaagcgcaactttgacatccggctgaaccccgagatttcaatcatctatagaaaggccaaagaatcaaggattgagaagtatggagtcgactccaaaaaaaataaccggtacctccacgaccagcttactctggtcacaacattgtcggaacattgcaattctccggaaaggaatatcgctttcgctaccattgacgaggaagaaagaattattgcagagttcaattcaaagctggacaaaggtaatatccgcttcgccttcggcatcgataacggcgaggtcgagctctcgacactgggggtgtaccttccagaatttaagcaaaagtccatcgagtcaagcttgactgaagtcaacaacgttgataagtatggctttgatacactgacgatacgcaatcttatgcactccgagaaggacgtgaatggaagggacagaaggattatcgacaacccttcctacttcctgaaggaggacttgtattgcagaacattcggaaagaatggagaagaatataaggccatgtttgataaagtcttcgagcaacgcaggctcctgacattggacctctcaacagcaaaggtcatttgtggcaggatcgtgacaaacggagacgttatctctctttataacctctggatgaggcacgcgcaacggaacatctacgatatgaacgagcacatcgagggaggtggtgccaaggtttatctcaagaagtccgaagtcttgaacgataatgagaaaagaaaattcttggattaccttaatgacgggaacgaaaggtatgaacggctgagcgatgccgagaaaaaagactacataaattggatctataaaatctgggatggggtcgaagtcgagaacgacaggttcgccgaagttaggcgcaaacagaaaaggcctggcttctattttcacaacgttttgctcgcggcctcatatataggagaagaagtccaggatgttaaggacatagccaacatcgacgacgtccggcatgtgttcaagttcagggaggactttaagcagttcaagcaggagaaggagatcctggatgagatcaacaaatataacataaaggtcatctctaatgaagaactggacttgcgcctcaaccagctcaagtcatcacttgtcgcgaacgttatcggagtcattgattatctctataagcagtacaaagagaggttcggtggcgagggtataatcgccaaagaggggttcggtatcgagaaagtggagtcagaccgcatgaagttctccggcaatatatataggatgctggagcgcaaactgtaccagaagttccaaaattacggcatggtccccccaatcaaaaatctgacggcttttaggagcaaggacaagagctacactcagataggctacatctgctttattgattatgatggcacatcccagcggtgccccatttgtaatgccaagctggcctacaaccatggcttggagtgcagcgagaaatgcggtttcgactcggaagggatcatgcactccaatgatggcattgctggttataacatcgctaaaaagggtttcgaatcaatcgtcaataagtag

SEQ ID NO: 175 - DNA, 3498 bp, Unknown
  Metagenome-Derived Sequence
  misc_feature (1)..(3498): Unk40 Csm1 gene (plant codon-optimized)
atgaatgactggcagaatctctacgccgtgcgcaaaaccattaattttgaattcaaacctagcctctatactaagaaacgggtccttgacgcacggattaaacggaattctgtcttgatcgacgtcaaaaataacacaatagagataatacatctgtttaacactcaaaatcaggaggttgctaatctcgtgcaacggtacttgcagaagctcacttccgattttgacatactggtcgagaaattcaagaatattactgatggaatctatatcaatggccgctacgagaatttccggatttacgtggagacgagcaagctgaagttggtggggaaagattttcgcgactgttactttcagatgaaaaatgagagagggaagagccgcaaggggtgggattactactaccagttcaacgcgaagactaacaaggccgaatttaggcacgtgaaattcggagatttccttacagtttcacatctgtttgccttccactatgataagacaaccaaagatggggagtttcagaggctcttgaaggaaaagataaacttctttataaaaaagtacaagtgcatccagatcgaattgagcgacttcctcgatgataacaaccgctttgaaaaatttatatctaagccggagatcttggatcggctgaagagattggcgtattgcatcggagacattctgtccctgatgaacattttttgcgacaagggtaagaacggcagcgacgggtgctctgtcttcattaaggacttgggggacttccgcataattgcactggacaacgattacgagagcgttgtcgccgaaattataaggcaagtgaattgcatcactaacccaaaagccttccattttaagttcacgctgaatttcaaggctaaaaaccccaacacccagttgtctggcaatgacgtttttttcaacgaaaaagacctccagaagaagctgaaagaagagatggacaagcttgaaaacaacaaaaaggaaaaatcggagtgccaatcttttctgtccaagtttgataatttggccggtaaggactgcacggacggacgctgggcggatattaagaacaaacaaggtttgccagataactaccaggatgcaaagaaggaatatgaatcatgtgagggaaaaaagaaagagctctcaaaggaaatagcttacaacgagaacgagaagaacaactacgctgtcattaaccaactgaaagcggccatatctaactctaagaatacccactttggagtcgtcattgaaaaggaagcaaattactacctcgcccttgaaaacaaaatctctaatggtaagctgaaggctgacaacaaatatgttctgaacaacctcaaaaataacctcttcagctgcaagctccttaagtacgagagccttacctggaaagcggtggaaaagctttgtctccttcctacgtcatcattgaacggtacctctaaggacgtcgtgggatactggtcaaagttctgcaaaggagttatcatcctcgagaagaagaacgaaaaggacaaacgcgatgtgttcgacctcggcatcatcaagaattatctcgtggagatcatgagcaaaactaacatctcgtctggttttaataaagaagacttcgataaactcgtgactctggatggaatcaaggcttactttgatgattactgcttcgaaaaccagtggatcgacgctgattgggacgaattccttggcctcgacagggagggctctatcgatttgtaccaaatatttaacaaggacttcgagctggatgagcactttgcgatttcagagaacgacaaggagaggattaagaggattaaatttgctcagttgattctcaaggagcgcttcgtggcgaagcagaagaatagcgagagaattagaaatttgttcacgatttattggcagaactgtttcaacaaattcgacacggagaagttcagggtccagccagagggtcggatttacatccgcgatatgtctcctgtcaatgacgcgaaacggtacagggaggaaaaagtgttgggggactttggcatactctttaatccagttgctaaggctatagaccaaagctctaaagacgtgaaggataggataggaaactttaatgattacctgaagaagcagcccctcaaaaacgagatctacgtcgttggtctggacaggggcgaaaattctttggtctcttacaccctcgtcaagtttaggaaaaaaatcgttggagaaaacgacatcagcgtgagattcgactccctgataggcacggaagcctgggttctggatgagatggtggaggtccgggacctctctgccgtcaagatttttaacgaaaagggaaagtggcgcaagtccgagttcgtggagcagaaagaagattactacttcgtggaaaagaacgaaggaaactatgatgaagacaaaaataaacaggacgcctgcaagaaaagggacgagcttaaaaagatgtacccagactacggcgacggccgcgaacgcgtggtcgtttgcccgatcaggtgtaaaccacagaccaaaaaggagaaacagcaggtcgagatggagaagacgggcgcctacgcggtgaaaatcctgtcgtgggaggacgaggacggcgcggtttataattacagagtggcccaagaaattcttaaggaagaaagattgagccaggtggaaaaaaatcgcgactttgagctgttcaataccgagaagttcaagaacggatacgtctcagctttgattgggttcatcggagagcgcgtcgagaccaataatgcttatgtttcactggagaatctcaacatgggtgacaagacgggaaagggcggcaattacagaaaaacatttggtgcctctgtgtatcagatgatcgagaataggcttatgagcaagcttgggtactcagtggtgaagggttcgtcctcggtccattctcaaaaagtgccgaaaatccgcaaggtggaggagctgaagaaagacgttctctccggggagaaaaacaacaaggattttcaaattggagtcatacagatcactgacgagactaatacctcacaaatctgcccgaattgtggatactcaatgaaccgctatggtcttgcgaagatcgaaaacggtgaactcaagctcacacttaatgcggaggagttgaaggataaggattttggaatagatatctcgaaggtgacgatattccgggttgatgatggagtcttcgcatggagatacagcggggtcgcgaccgaaaaactggataagagccataatgatttttgccgcgtcctctccaaaaccaggcagaacgagaccaagagcaaggatttcattcgctgcgtccactgtgggtttgactctaggttcccaactaagaatcacgagaagctcaaaaaggtgaacggtggcgacgtgttggcggcctataatatcgccaagagaggcttggagttcatccagtgcaaatccgaagttatcaattga

SEQ ID NO: 176 - DNA, 4029 bp, Unknown
  Metagenome-Derived Sequence
  misc_feature (1)..(4029): Unk41 Csm1 gene (plant codon-optimized)
atgcttacaaagtttgcgaacctctacgagcttacaaaaaccgttaggttcggactcaccccaaagaattcatacaagaaggtgtcagacttcttcgaactgaccgaaaaaagcttggaatcagtccaggcggagatcgtcgagagggaaaaagagaaaataaacatcacatctactgaggaatcgatcaaaaaaattcgcgcatatgtggacgagctgaaaaaacagtccgctcagtggaagaccatataccaacgcgaggatatgattgcggtcacaaaagagtactataagaaactcgaaaaagaggcggggttcgatggtttctgggaagatcgcggaaagaagcaaccgcaaacttcagaaatcatgctcagcgcgctgagcaaggaatacaacaataagccaaggagagaatatatcatcacttactgggcacttcttcttcagaaaaccgaacagctcaacagctattttgagcctctcctggaaaagtatgaggagagcctctctcggaaggaacaggctcaccttaagcctaatctggtggacttcaggaagcagttcctcagcctcctcaatgtctccaataagtggctcatgccggtcataaaccaaagcatagtgttccctaagatccacaatgccagcaaaggcgagcagaaccggaaggttaaggatttcatctccgaggaaggcagacaaaagcgcatccagctgcagtctattggacgctccctgcgggacttctttgaggctaacggctccagagtgcccttcgggaaggcgactcttaattatttcacagctcgccagaagcctaatcgcttcgactccgagatcgatgccctcatgctcgacctggaaatcgaggaaatcgtcaggaaagttaaagacctcaacggcgaggaactcaaaaattattttaaatatcaaacttatgcgaccggtgacaagctggacgcattcctcggccatagctacatgaccttgattgagaaaattcagctctttaagcccaaacccattcccgcctccgtcaggttcagcttggcagagagacttagcaagaagatgaatctccctatggagaaggtcacagcaatttttgacgagatcgggaacccaatcgacattgcgagggagtacgagcaggctctggaccagaagaatttcgatcttaataagtatccaatcaatattgcattcgactatgcgtgggagtcttgtgcctcactgatcaaaggcaggatctctgagggggatttcccaaaggcacagtgcctggccatacttaaaaaatttaacgcagacggcgatgattttaagctgtacgccaacctgcgctatatcagggatgaactggctcctatcgagcacaacaacccgtcggcggacatagagaaggaacttgtttacaatattcagaagactatcggcataatctacagcagcatgccttccgagtaccagaaatatcttgacattatccttaagtgggtcgaaatgccgaaaattgaaagaaattcctctgattccaattttatttttgcgaaacagaagatcggtctgcttcgcggtggcttgaagaataagataaacaagcacgcagagatcacgaacaagttcaaaaatctctctatggcgtttggtaggtcctgctcggacctgagggataagctcagagaggagcatgaactttctaagataaagtactattccgtgctcattgaggattctaagaaaaataggcatttgttgatgttgccgctggaaacaggtgaccaaaagatgtcggcggtcgaaattgaaaatagactggatattctcgaaaataagttcgtcgaggacgccccatcggcgaacgcctacatcgcgtcgaaagtgtcgtctttcacttcaaaggctttggttaagatgcttaagaatcctaagggcagcgaggactttcacattggctcagagaagtacaaactccatgattacaataataaaattaagaaagagtggaagatttatcaggacgacagcaagttcctgtcctacgccaagaagtgcctttcggagtccaagatggcgatgaaccagcattgggagaagttcggttggaattttgaaggttgcaagacttatgcagatttggagaaagaggtcgacattaaggggtactctctcgaaaagaagtacatttcgttcgagaacaccgagatgctcgtgtacgagcagggatgccttctctttccaattgtcaatcaggattacgcctcagaagtgtgccagaacattttcaccgggaacaagaacgcttttacaatcgaaatcgagaaggggcttcaagagcaggacggctatcttattcatccagagttcaccattttctaccagaagcccacagaggactacaagaaaagcaatagatatggccgcttccaactttccgcgaacttttcgcttgaagtgaagaagatatccgacaattttaagactaagaaggaaaaactgaagaacataagagacaaggactccttccaaaaggacgtccagatattcaatgaatcaatcaatgcccaacttcgcatcaacgaggatgtttacttttacggtatagatcggggaatcaacgagctggccaccctgtgcttgctcaacaacaagaacaaaattcaggactttatcgttttcaagaaggaaaaaaagaagaggaattcggagaatcatctcagggaggctggagatttctacacctatgtggacttcgagaaacagaatatcctcgaccttacgaacatcaaggtcgaaacgtggaatatgcgcgatgagatccatccgaacagcaactttctgaagcaagctttcaagaaaattgaggctgatcctgagatgaaaatgatcgcaacgcagctcggatatggtatcaatgaaaagaaacagtgtaccattctggttgagtacccgtccgacagatcgaatactctcaagctgcgcatgaaccacttccagagagccctccagttcgccaccagccactcggaaaagcgcgatatcgtcggaggtatagccgagcggaattttgagggtaccgacctcgaaaatccctcagacgaggttaagaaacagataatacaggacttgttcggcctcgggtcagatttcctcatcgacgagaagaaggcgggagtgattaacgagctccaaacgaaaaaatttcgcttcgagaagatttactctaggaaccagcagctctttctcgagatgttcgagccgctcatacaacaactgattgaatggtaccagcacaagaatgatccagactatgagaaaaccggcaaggcaaaatacgaagagatggaggatctggataccctgaagcggggcgtgaccgcgaatatggtgggcgtcttttcgttccttatgcagaagttcccgggagtcatagttctcgaaaatattgcgaaggaaaaactggaaaagccggtccagtctaaactggacgaacatactcgcgaggtcgagtcccaccaggaggcggagcaccaccgctgggcaggggttgaactgtacagatacatggaaaaaaagcttgttcaaaagttctcaaactggcgccagcccaccggcgagatcttcaacctgacccctccgtttgcgaatttggagtctctgaacaaacaaaccatgactattaactccgaacgcatagaaaacatgttccaattcggaatcttctgctacacccccgcggagtacacgaccaaaacatgcccgtgctgcaacaaataccatattagaaatagaaagaagggcaatactttcgattctatcatttgcaagaacgagcactgcggttttgatactcggtataatgagccgctgcacgagtccttcaaccctgccaggaatgttgagattgcgttgaggttgaatccagagttctccgaagcgctgccgaagatccgctctggggaccagtcggctgcgttcaatatagccaagaagggcctgatcattatggagaacaaactttgttga

SEQ ID NO: 177 - protein, 9 aa, Unknown
  Conserved motif
  MISC_FEATURE (1)..(9): conserved motif; X1=S/T; X2=F/L; X3=N/S; X4=Y/F/R; X5=Y/F/H; X6=T/S/A; X7=I/V/L/R; X8=N/S/F/R
  MISC_FEATURE (1)..(1): X1=S or T
  MISC_FEATURE (2)..(2): X2=F or L
  MISC_FEATURE (3)..(3): X3=N or S
  MISC_FEATURE (4)..(4): X4=Y or F or R
  MISC_FEATURE (5)..(5): X5=Y or F or H
  MISC_FEATURE (6)..(6): X6=T or S or A
  MISC_FEATURE (7)..(7): X7=I or V or L or R
  MISC_FEATURE (8)..(8): X8=N or S or F or R
XXXXXXXXK

SEQ ID NO: 178 - protein, 11 aa, Unknown
  conserved motif
  MISC_FEATURE (1)..(11): Conserved motif in Sm-type Cms1 nucleases
  MISC_FEATURE (1)..(1): X=F, Y, I, or W
  MISC_FEATURE (2)..(2): X=K, E, L, or N
  MISC_FEATURE (3)..(3): X=A, S, G, or N
  MISC_FEATURE (4)..(4): X=any amino acid
  MISC_FEATURE (5)..(5): X=Q, A, E, K, or R
  MISC_FEATURE (7)..(8): X=any amino acid
  MISC_FEATURE (9)..(9): X=F, L, or Y
  MISC_FEATURE (10)..(10): X=any amino acid
  MISC_FEATURE (11)..(11): X=E, Q, K, S, or D
XXXXXKXXXXX

SEQ ID NO: 179 - protein, 14 aa, Unknown
  conserved motif
  MISC_FEATURE (1)..(14): conserved motif in Sm-type Cms1 nucleases
  MISC_FEATURE (1)..(1): X=F, L, V, or I
  MISC_FEATURE (2)..(2): X=E, K, N, D, or S
  MISC_FEATURE (4)..(4): X=L, F, I, or M
  MISC_FEATURE (6)..(6): X=L, Y, F, or M
  MISC_FEATURE (7)..(7): X=R, S, or K
  MISC_FEATURE (8)..(8): X=A or S
  MISC_FEATURE (9)..(9): X=L, I, F, or V
  MISC_FEATURE (10)..(10): X=any amino acid
  MISC_FEATURE (12)..(12): X=L or M
  MISC_FEATURE (13)..(13): X=C or I
  MISC_FEATURE (14)..(14): X=F or R
XXSXTXXXLXKXXX

SEQ ID NO: 180 - protein, 22 aa, Unknown
  conserved motif
  MISC_FEATURE (1)..(22): conserved motif in Sm-type Cms1 nucleases
  MISC_FEATURE (2)..(3): X2=any amino acid; X3=any amino acid
  MISC_FEATURE (4)..(4): X4=F/I/Y
  MISC_FEATURE (5)..(5): X=W or F
  MISC_FEATURE (6)..(16): X6 through X16=any amino acid
  MISC_FEATURE (17)..(17): X=I, L, T, V, or W
  MISC_FEATURE (18)..(18): X18=R or S
  MISC_FEATURE (19)..(19): X=L or I
  MISC_FEATURE (20)..(20): X=N or T
WXXXXXXXXXXXXXXXXXXXPE

SEQ ID NO: 181 - protein, 12 aa, Unknown
  conserved motif
  MISC_FEATURE (1)..(12): conserved RuvCI motif in SmCms1 nucleases
  MISC_FEATURE (1)..(1): X1=Y/W/F
  MISC_FEATURE (2)..(2): X2=any amino acid
  MISC_FEATURE (3)..(3): X3=Y/F/L/I
  MISC_FEATURE (4)..(4): X=G or W
  MISC_FEATURE (5)..(5): X5=I/L/V
  MISC_FEATURE (7)..(7): X7=any amino acid
  MISC_FEATURE (8)..(8): X8=G/N
  MISC_FEATURE (9)..(10): X9=any amino acid; X10=any amino acid
  MISC_FEATURE (11)..(11): X11=E/D/Q
  MISC_FEATURE (12)..(12): X12=L/F
XXXXXDXXXXXX

SEQ ID NO: 182 - protein, 17 aa, Unknown
  conserved motif
  MISC_FEATURE (1)..(17): conserved motif in SmCms1 nucleases
  MISC_FEATURE (1)..(1): X1=D/N
  MISC_FEATURE (2)..(2): X2=L/M
  MISC_FEATURE (3)..(3): X3=T/S
  MISC_FEATURE (4)..(4): X4=any amino acid
  MISC_FEATURE (5)..(5): X5=A/S/V
  MISC_FEATURE (7)..(7): X7=L/M/V/I
  MISC_FEATURE (8)..(8): X8=I/L/V/K
  MISC_FEATURE (9)..(9): X9=any amino acid
  MISC_FEATURE (10)..(10): X10=any amino acid
  MISC_FEATURE (11)..(11): X11=any amino acid
  MISC_FEATURE (12)..(12): X=I, G, or L
  MISC_FEATURE (13)..(13): X13=I/V/Y/F
  MISC_FEATURE (14)..(14): X14=any amino acid
  MISC_FEATURE (16)..(16): X16=G/A/K
  MISC_FEATURE (17)..(17): X17=D/G/P
XXXXXKXXXXXXXXNXX

SEQ ID NO: 183 - protein, 9 aa, Unknown
  conserved motif
  MISC_FEATURE (1)..(9): conserved motif in Sm-type Cms1 nucleases
  MISC_FEATURE (1)..(1): X=I, L, or V
  MISC_FEATURE (2)..(2): X=V, T, A, C, or S
  MISC_FEATURE (3)..(3): X=A, S, or G
  MISC_FEATURE (5)..(5): X=M, A, I, or V
  MISC_FEATURE (6)..(6): X=V, I, or T
  MISC_FEATURE (7)..(7): X=G or W
  MISC_FEATURE (8)..(8): X=V or I
  MISC_FEATURE (9)..(9): X=I, L, or V
XXXNXXXXX

SEQ ID NO: 184 - protein, 10 aa, Unknown
  conserved motif
  MISC_FEATURE (1)..(10): conserved RuvCII motif in Sm-type Cms1 nucleases
  MISC_FEATURE (1)..(2): X=any amino acid
  MISC_FEATURE (3)..(3): X=I, V, or M
  MISC_FEATURE (4)..(5): X=any amino acid
  MISC_FEATURE (7)..(10): X=any amino acid
XXXXXEXXXX

SEQ ID NO: 185 - protein, 13 aa, Unknown
  conserved motif
  MISC_FEATURE (1)..(13): conserved motif in Sm-type Cms1 nucleases
  MISC_FEATURE (3)..(9): X=any amino acid
  MISC_FEATURE (12)..(12): X=any amino acid
TSXXXXXXXCPXC

SEQ ID NO: 186 - protein, 16 aa, Unknown
  conserved motif
  MISC_FEATURE (1)..(16): conserved RuvCIII motif in Sm-type Cms1 nucleases
  MISC_FEATURE (2)..(3): X=any amino acid
  MISC_FEATURE (5)..(5): X=A, G, T, or S
  MISC_FEATURE (6)..(6): X=Y or F
  MISC_FEATURE (7)..(7): X=N or L
  MISC_FEATURE (8)..(8): X=I or V
  MISC_FEATURE (9)..(9): X=A, S, or I
  MISC_FEATURE (10)..(16): X=any amino acid
DXXAXXXXXXXXXXXX

SEQ ID NO: 187 - protein, 12 aa, Unknown
  conserved motif
  MISC_FEATURE (1)..(12): conserved motif; X3=I/L/V; X4=N/K; X5=I/L/V/P/S; X9=F/Y; X10=A/T
  MISC_FEATURE (3)..(3): X3=I/L/V
  MISC_FEATURE (4)..(4): X4=N/K
  MISC_FEATURE (5)..(5): X5=any amino acid
  MISC_FEATURE (9)..(9): X9=F/Y
  MISC_FEATURE (10)..(10): X10=A/S/T
YPXXXAFDXXWE

SEQ ID NO: 188 - protein, 12 aa, Unknown
  conserved motif
  MISC_FEATURE (1)..(12): conserved motif; X1=I/L; X2=I/V; X5 through X7=any amino acid; X8=N/D; X9=R/K; X10=H/F/Y; X11=I/L/V; X12=I/L/F
  MISC_FEATURE (1)..(1): X1=I/L
  MISC_FEATURE (2)..(2): X2=I/V
  MISC_FEATURE (5)..(7): X5 through X7=any amino acid
  MISC_FEATURE (8)..(8): X8=N/D
  MISC_FEATURE (9)..(9): X9=R/K
  MISC_FEATURE (10)..(10): X10=H/F/Y
  MISC_FEATURE (11)..(11): X11=I/L/V
  MISC_FEATURE (12)..(12): X12=I/L/F
XXEDXXXXXXXX

SEQ ID NO: 189 - protein, 13 aa, Unknown
  conserved motif
  MISC_FEATURE (1)..(13): conserved motif found in Sulf-type Cms1 nucleases
  MISC_FEATURE (1)..(1): X=Y, C, or S
  MISC_FEATURE (2)..(2): X=any amino acid
  MISC_FEATURE (3)..(3): X=I or V
  MISC_FEATURE (4)..(4): X=any amino acid
  MISC_FEATURE (6)..(6): X=F, L, I, or V
  MISC_FEATURE (9)..(10): X=any amino acid
  MISC_FEATURE (11)..(11): X=L or I
  MISC_FEATURE (12)..(12): X=any amino acid
XXXXSXTSXXXXK

SEQ ID NO: 190 - protein, 14 aa, Unknown
  conserved motif
  MISC_FEATURE (1)..(14): conserved motif found in Sulf-type Cms1 nucleases
  MISC_FEATURE (1)..(1): X=E or A
  MISC_FEATURE (2)..(2): X=any amino acid
  MISC_FEATURE (3)..(3): X=I or L
  MISC_FEATURE (4)..(4): X=E, K, or I
  MISC_FEATURE (5)..(5): X=K, H, or R
  MISC_FEATURE (7)..(7): X=I, V, or L
  MISC_FEATURE (9)..(9): X=any amino acid
  MISC_FEATURE (10)..(10): X=K or N
  MISC_FEATURE (11)..(11): X=any amino acid
  MISC_FEATURE (12)..(12): X=Y or H
  MISC_FEATURE (13)..(13): X=any amino acid
  MISC_FEATURE (14)..(14): X=L or F
XXXXXEXDXXXXXX

SEQ ID NO: 191 - protein, 9 aa, Unknown
  conserved motif
  MISC_FEATURE (1)..(9): conserved motif found in Sulf-type Cms1 nucleases
  MISC_FEATURE (1)..(1): X=L, S, or F
  MISC_FEATURE (3)..(3): X=L, F, or V
  MISC_FEATURE (5)..(5): X=I, F, or L
  MISC_FEATURE (6)..(6): X=I or V
  MISC_FEATURE (8)..(8): X=Q or K
XLXPXXNXD

SEQ ID NO: 192 - protein, 9 aa, Unknown
  conserved motif
  MISC_FEATURE (1)..(9): conserved motif found in Sulf-type Cms1 nucleases
  MISC_FEATURE (1)..(1): X1=L or I
  MISC_FEATURE (2)..(2): X2=H or T
  MISC_FEATURE (6)..(6): X6=any amino acid
  MISC_FEATURE (7)..(7): X7=I/V/L/M
  MISC_FEATURE (8)..(8): X8=F, S, or T
XXPEFXXXY

SEQ ID NO: 193 - protein, 18 aa, Unknown
  conserved motif
  MISC_FEATURE (1)..(18): conserved motif found in Sulf-type Cms1 nucleases
  MISC_FEATURE (1)..(1): X=N or K
  MISC_FEATURE (3)..(3): X=Y or F
  MISC_FEATURE (4)..(4): X=S, G, or W
  MISC_FEATURE (5)..(5): X=R, K, or S
  MISC_FEATURE (6)..(6): X=F, L, or V
  MISC_FEATURE (7)..(7): X=Q or E
  MISC_FEATURE (8)..(8): X=M, L, F, or I
  MISC_FEATURE (9)..(9): X=any amino acid
  MISC_FEATURE (10)..(10): X=A, C, or G
  MISC_FEATURE (11)..(11): X=any amino acid
  MISC_FEATURE (12)..(12): X=F, L, or I
  MISC_FEATURE (13)..(14): X=any amino acid
  MISC_FEATURE (15)..(15): X=E, D, or H
  MISC_FEATURE (16)..(16): X=F, Y, I, or V
  MISC_FEATURE (17)..(17): X=I, L, V, or K
  MISC_FEATURE (18)..(18): X=P or K
XRXXXXXXXXXXXXXXXX

SEQ ID NO: 194 - protein, 14 aa, Unknown
  conserved moti
  MISC_FEATURE (1)..(14): conserved RuvCI motif; X6=I/L/Q; X7=K/N; X8=E/Q; X14=I/L/V
  MISC_FEATURE (3)..(3): X=R or S
  MISC_FEATURE (4)..(4): X=G or W
  MISC_FEATURE (5)..(5): X=I, Q, or L
  MISC_FEATURE (6)..(6): X6=I/L/Q
  MISC_FEATURE (7)..(7): X7=K/N
  MISC_FEATURE (8)..(8): X8=E/Q
  MISC_FEATURE (11)..(11): X=T or V
  MISC_FEATURE (14)..(14): X14=I/L/V
GIDXXXXXLAXLCX

SEQ ID NO: 195 - protein, 11 aa, Unknown
  conserved motif
  MISC_FEATURE (1)..(11): conserved motif found in Sulf-type Cms1 nucleases
  MISC_FEATURE (1)..(1): X=I or V
  MISC_FEATURE (3)..(3): X=D or N
  MISC_FEATURE (4)..(4): X=L or I
  MISC_FEATURE (5)..(5): X=S or T
  MISC_FEATURE (6)..(6): X=N or D
  MISC_FEATURE (7)..(7): X=L or I
  MISC_FEATURE (8)..(8): X=R or K
  MISC_FEATURE (9)..(9): X=V or I
  MISC_FEATURE (10)..(10): X=E or D
  MISC_FEATURE (11)..(11): X=T, S, or K
XLXXXXXXXXX

SEQ ID NO: 196 - protein, 11 aa, Unknown
  conserved motif
  MISC_FEATURE (1)..(11): conserved motif found in Sulf-type Cms1 nucleases
  MISC_FEATURE (1)..(1): X=L or M
  MISC_FEATURE (2)..(3): X=any amino acid
  MISC_FEATURE (4)..(4): X=L, M, or Y
  MISC_FEATURE (5)..(5): X=A, S, or P
  MISC_FEATURE (6)..(6): X=Y or S
  MISC_FEATURE (7)..(7): X=I, V, or D
  MISC_FEATURE (8)..(8): X=R or S
  MISC_FEATURE (9)..(9): X=any amino acid
  MISC_FEATURE (10)..(10): X=L, N, or V
  MISC_FEATURE (11)..(11): X=Q or T
XXXXXXXXXXX

SEQ ID NO: 197 - protein, 19 aa, Unknown
  conserved motif
  MISC_FEATURE (1)..(19): conserved motif found in Sulf-type Cms1 nucleases
  MISC_FEATURE (1)..(1): X=E or Q
  MISC_FEATURE (2)..(2): X=L or M
  MISC_FEATURE (3)..(3): X=D, E, or K
  MISC_FEATURE (4)..(5): X=any amino acid
  MISC_FEATURE (6)..(6): X=D, E, or G
  MISC_FEATURE (7)..(7): X=any amino acid
  MISC_FEATURE (8)..(8): X=L or S
  MISC_FEATURE (10)..(10): X=any amino acid
  MISC_FEATURE (11)..(11): X=G, W, or S
  MISC_FEATURE (12)..(12): X=V or I
  MISC_FEATURE (13)..(13): X=V or T
  MISC_FEATURE (14)..(14): X=A or G
  MISC_FEATURE (16)..(16): X=M or I
  MISC_FEATURE (17)..(17): X=V or I
  MISC_FEATURE (19)..(19): X=V or I
XXXXXXXXKXXXXXNXXGX

SEQ ID NO: 198 - protein, 10 aa, Unknown
  conserved motif
  MISC_FEATURE (1)..(10): conserved RuvCII motif found in Sulf-type Cms1 nucleases
  MISC_FEATURE (2)..(2): X=any amino acid
  MISC_FEATURE (3)..(3): X=V, A, or G
  MISC_FEATURE (4)..(4): X=Y, K, R, or V
  MISC_FEATURE (5)..(5): X=I or V
  MISC_FEATURE (6)..(6): X=any amino acid
  MISC_FEATURE (7)..(7): X=L, F, or I
  MISC_FEATURE (9)..(9): X=D or N
  MISC_FEATURE (10)..(10): X=L or I
YXXXXXXEXX

SEQ ID NO: 199 - protein, 16 aa, Unknown
  conserved motif
  MISC_FEATURE (1)..(16): conserved motif found in Sulf-type Cms1 nucleases
  MISC_FEATURE (2)..(2): X=G or W
  MISC_FEATURE (3)..(3): X=L or V
  MISC_FEATURE (4)..(4): X=G, W, or E
  MISC_FEATURE (5)..(5): X=T or L
  MISC_FEATURE (6)..(6): X=Y or M
  MISC_FEATURE (7)..(7): X=any amino acid
  MISC_FEATURE (8)..(8): X=F or Y
  MISC_FEATURE (9)..(9): X=F, L, or M
  MISC_FEATURE (11)..(11): X=any amino acid
  MISC_FEATURE (12)..(12): X=Q or K
  MISC_FEATURE (14)..(14): X=L or V
  MISC_FEATURE (15)..(15): X=any amino acid
AXXXXXXXXEXXLXXK

SEQ ID NO: 200 - protein, 21 aa, Unknown
  conserved motif
  MISC_FEATURE (1)..(21): conserved motif found in Sulf-type Cms1 nucleases
  MISC_FEATURE (2)..(3): X=any amino acid
  MISC_FEATURE (5)..(5): X=I or V
  MISC_FEATURE (6)..(6): X=I, F, or V
  MISC_FEATURE (7)..(7): X=any amino acid
  MISC_FEATURE (8)..(8): X=F or Y
  MISC_FEATURE (9)..(9): X=V, I, or T
  MISC_FEATURE (10)..(10): X=any amino acid
  MISC_FEATURE (11)..(11): X=P or A
  MISC_FEATURE (12)..(13): X=any amino acid
  MISC_FEATURE (15)..(15): X=S or T
  MISC_FEATURE (16)..(17): X=any amino acid
  MISC_FEATURE (20)..(20): X=any amino acid
FXXGXXXXXXXXXTXXXCPXC

SEQ ID NO: 201 - protein, 12 aa, Unknown
  conserved motif
  MISC_FEATURE (1)..(12): conserved RuvCIII motif found in Sulf-type Cms1 nucleases
  MISC_FEATURE (2)..(3): X2=any amino acid; X3=any amino acid
  MISC_FEATURE (4)..(4): X=G or W
  MISC_FEATURE (6)..(6): X6=D/Q/E
  MISC_FEATURE (7)..(7): X7=N/S
  MISC_FEATURE (8)..(8): X8=G/A
  MISC_FEATURE (10)..(10): X10=Y/F
  MISC_FEATURE (11)..(11): X11=H/L/I/N
IXXXDXXXAXXI

SEQ ID NO: 202 - DNA, 185 bp, Oryza sativa
  misc_feature (1)..(185): sequencing from CAO1 locus in experiment 201 callus piece 43 showing 431bp deletion relative to wild-type sequence
ttcagccgagatcgcaaatattcgtttcaaaacttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttg

SEQ ID NO: 203 - DNA, 413 bp, Oryza sativa
  misc_feature (1)..(413): CAO1 locus sequencing data from experiment 202 callus piece 2 indicating deletion and insertion at this locus relative to wild-type
  misc_feature (115)..(230): partial insertion of ZmUbi promoter
  misc_feature (249)..(252): mutation of PAM site present in repair donor template plasmid
ttcagccgagatcgcaaatattcgtttcaaaacaaattactgtaaccggcgacgcagccacgggacgtggatcggacggcgcggaggtggacggaggagggatcaacggctgagttcaaacaagtgtgacaaaaaaaatatgtggtaattttttataacttagacatgcaatgctcattatctctagagaggggcacgaccgggtcacgctgcactgcagaagcttgctgccttcaggtgttgctccaggcaggtgagttcttcttgttgttccttgaatctgtttttgttgttgttgtttggcgattcttgaatttgttttggggtatctggcgatgggaggaaccatgtttcttgtttggtttttgggttcaggtggccattcttgatgaaaaactgagtgtttgagtttg

SEQ ID NO: 204 - DNA, 399 bp, Oryza sativa
  misc_feature (1)..(399): sequencing of CAO1 locus from callus piece 3 in experiment 211
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagacagcgatgccacagtggtcatggatgctacgatcgaacagtgcgacccaaaaacaaaaataaaaacgcacaaatactccccatatttttcctcaaccgagggtggttttgtctaatttttttttctttctccgcgaaaagatatttcgaaatctctaatccggagaacgcaatc

SEQ ID NO: 205 - DNA, 420 bp, Oryza sativa
  misc_feature (1)..(420): sequencing from CAO1 locus of callus piece 5 in experiment 211
  misc_feature (107)..(107): G>A mutation
  misc_feature (246)..(246): A>G mutation
tgtctgaacaaaaacatcaaccatcacaaagaatccaatcagaagaacaaaaatggtaactccattgcactgctcaaactcaaacactcagtttttcatcaagaatagccacctgaacccaaaaaccaaacaagaaacatggttcctcccatcgccagataccccaaaacaaattcaagaatcgccaaacaacaacaacaaaaacagattcaaggaacaacaagaagaactcagcggcagcaaaggcagcgatgccacagtggtcatggatgctacgatcgaacagtgcgacccaaaaacaaaaataaaaacgcacaaatactccccatatttttcctcaaccgagggtggttttgtctaatttttttttctttctccgcgaaaagatatttcgaaatctctaatccggagaacgcaatc

SEQ ID NO: 206 - DNA, 440 bp, Oryza sativa
  misc_feature (1)..(440): sequence of CAO1 locus in callus piece 15 from experiment 212
  misc_feature (237)..(238): TT>GC mutation
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcaacacctgaaggcagcaaagacagcgatgccacagtggtcatggatgctacgatcgaacagtgcgacccaaaaacaaaaataaaaacgcacaaatactccccatatttttcctcaaccgagggtggttttgtctaatttttttttctttctccgcgaaaagatatttcgaaatctctaatccggagaacgcaatc

SEQ ID NO: 207 - DNA, 266 bp, Oryza sativa
  misc_feature (1)..(266): sequence of CAO1 locus from callus piece 34 from experiment 233
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaccacgcgacgtggcgcgccactcgccgcgcgccccttatctctcgaccccgtcgcgacgccctgaacccttatctgctcgcggcgcaccacgtg

SEQ ID NO: 208 - DNA, 217 bp, Oryza sativa
  misc_feature (1)..(217): partial sequence of CAO1 locus in callus piece #36 from experiment 222 showing a 244bp deletion relative to WT
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatgtctaatttttttttctttctccgcgaaaagatatttcgaaatctctaatccggagaacgcaatc

SEQ ID NO: 209 - DNA, 246 bp, Oryza sativa
  misc_feature (1)..(246): partial sequence of CAO1 locus in callus piece #50 from experiment 223 showing a 216bp deletion relative to WT
tgtctgaacaaaaacatcaaccatcacaaagaatccaatcagaagaacaaaaatggtaactccattgcactgctcaaactcaaacactcagtttttcatcaagaatggccacctgaacccaaaaacaaaaataaaaacgcacaaatactccccatatttttcctcaaccgagggtggttttgtctaatttttttttctttctccgcgaaaagatatttcgaaatctctaatccggagaacgcaatc

SEQ ID NO: 210 - DNA, 338 bp, Oryza sativa
  misc_feature (1)..(338): partial sequence of CAO1 locus in callus piece #35 from experiment 224 showing a 216bp deletion relative to WT
  misc_feature (237)..(238): PAM site mutation
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcatatttttcctcaaccgagggtggttttgtctaatttttttttctttctccgcgaaaagatatttcgaaatctctaatccggagaacgcaatc

SEQ ID NO: 211 - DNA, 438 bp, Oryza sativa
  misc_feature (1)..(438): partial sequence of CAO1 locus in callus piece #33 from experiment 231 showing a 24bp deletion relative to WT
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctttctgatgagcaagtgcggcagcaaagacagcgatgccacagtggtcatggatgctacgatcgaacagtgcgacccaaaaacaaaaataaaaacgcacaaatactccccatatttttcctcaaccgagggtggttttgtctaatttttttttctttctccgcgaaaagatatttcgaaatctctaatccggagaacgcaatc

SEQ ID NO: 212 - DNA, 485 bp, Oryza sativa
  misc_feature (1)..(485): partial sequence of CAO1 locus in callus piece #43 from experiment 231 showing a 211bp deletion relative to WT and a 159bp insertion from the repair donor template
  misc_feature (236)..(394): insertion from the repair donor template
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcaacacctgaaggcagcaagcttctgcagggcagcgtgacccggtcgtgcccctctctagagataatgagcattgcatgtctaagttataaaaaattaccacatattttttttgtcacacttgtttgaagtgcagtttatctatctttatcgcgacgtggcgcgccactcgccgcgcgccccttatctctcgaccccgtcgcgacgccctgaacccttatctgctcgcggcgcaccacgtg

SEQ ID NO: 213 - DNA, 627 bp, Oryza sativa
  misc_feature (1)..(627): partial sequence of CAO1 locus in callus piece #5 from experiment 239 showing a 392bp deletion relative to WT and a 349bp insertion from the repair donor template
  misc_feature (236)..(591): insertion from the repair donor template
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcaacacctgaaggcagcaagcttctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatactactacaataatatcagtgttttagagaatcatataaatgaacagttagacatggtctaaaggacaattgagtattttgacaacaggactctacagttttatctttttagtgtgcatgtgttctcctttttttttgcaaatagcttcagattgattttgttttgaaacgaatatttgcgatctcggctgaa

SEQ ID NO: 214 - DNA, 659 bp, Oryza sativa
  misc_feature (1)..(659): partial sequence of CAO1 locus in callus piece #1 from experiment 218 showing a 38bp deletion relative to WT and a 257bp insertion from the repair donor template
  misc_feature (236)..(492): insertion from the repair donor template
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcaacacctgaaggcaagcttctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatactactacaataatatcagtgttttagagaatcatataaatgaacagttagacatggtctagccacagtggtcatggatgctacgatcgaaaaacgcacaaatactccccatatttttcctcaaccgagggtggttttgtctaatttttttttctttctccttgtctaatttttttttctttctccgcgaaaagatatttcgaaatctctaatccggagaacgcaatc

SEQ ID NO: 215 - DNA, 557 bp, Oryza sativa
  misc_feature (1)..(557): partial sequence of CAO1 locus in callus piece #20 from experiment 241 showing a 397bp deletion relative to WT and a 356bp insertion from the repair donor template
  misc_feature (166)..(521): insertion from the repair donor template
tgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcaacacctgaaggcagcaagcttctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatactactacaataatatcagtgttttagagaatcatataaatgaacagttagacatggtctaaaggacaattgagtattttgacaacaggactctacagttttatctttttagtgtgcatgtgttctcctttttttttgcaaatagcttcagattgattttgttttgaaacgaatatttgcgatctcggctgaa

SEQ ID NO: 216 - DNA, 630 bp, Oryza sativa
  misc_feature (1)..(630): partial sequence of CAO1 locus in callus piece #1 from experiment 248 showing a 304bp deletion relative to WT and a 402bp insertion from the repair donor template
  misc_feature (166)..(567): insertion from the repair donor template
tgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcaacacctgaaggcagcaagcttctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatactactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttcacgcaggaacgcatctcagccgttgatccctcctccgtccacctccgcgccgtccgatccac

SEQ ID NO: 217 - DNA, 372 bp, Oryza sativa
  misc_feature (1)..(372): partial sequence of CAO1 locus in callus piece #30 from experiment 252 showing a 364bp deletion relative to WT and a 95bp insertion from the repair donor template
  misc_feature (236)..(330): insertion from the repair donor template
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcaacacctgaaggcagcaagcttctgcagtgcagcgtgacccggtcgtgcccctctctagagataatgagcattgcatgtctaagtgtcccgtggctgcgtcgccggttacagtaatttgttttgaaa

SEQ ID NO: 218 - DNA, 441 bp, Oryza sativa
  misc_feature (1)..(441): partial sequence of CAO1 locus in callus piece #35 from experiment 256 showing a 470bp deletion relative to WT and a 238bp insertion from the repair donor template
  misc_feature (166)..(403): insertion from the repair donor template
tgctcaaactcaaacactcagtttttcatcaagaatggccacctgaacccaaaaaccaaacaagaaacatggttcctcccatcgccagataccccaaaacaaattcaagaatcgccaaacaacaacaacaaaaacagattcaaggaacaacaagaagaactcacctgcctggagcaacacctgaaggcagcaagcttctgcagtgcagcgtgacccggtcgtgcccctctctagagataatgagcattgcatgtctaagttataaaaaattaccacatattgacccggtcgtgcccctctctagagataatgagcattgcatgtctaagttataaaaaattaccacatatataatataatctatactactacaataatatcagtgttttagagaatcatataatcgtttacgaaagtttagtgaatacaaatacttgcggg

SEQ ID NO: 219 - DNA, 186 bp, Oryza sativa
  misc_feature (1)..(186): Sequence of the CAO1 locus in callus piece 45 from experiment 253
tgtctgaacaaaaacatcaaccatcacaaagaatccaatcagaagaacaaaaatggtaactccattgcactgctcaaactcaaacactcagtttttcatcaagaatggccacctgaacccaaaaaccaaacaagatctctaatccggagaacgcaatctgggccacgcgacgtggcgcgccactcg

SEQ ID NO: 220 - DNA, 136 bp, Oryza sativa
  misc_feature (1)..(136): sequence of the CAO1 locus in callus piece 33B from experiment 255
  misc_feature (69)..(69): inserted base
tgctcaaactcaaacactcagtttttcatcaagaatggccacctgaacccaaaaaccaaacaagaaactatgaagatatttcgaaatctctaatccggagaacgcaatctgggccacgcgacgtggcgcgccactc

SEQ ID NO: 221 - DNA, 3327 bp, Unknown
  metagenome-derived sequence
  misc_feature (1)..(3327): Unk4 Cms1 gene (alternate codon usage)
atggaaaaattcaagattactcggaccatcaggttcaaggctaacccaatctccattaataagcttcaagaccagactaaatcactttctgagaactctgaagcagacatcgttgggattattaataacgctaaccagattatcaatgacctggagggactgattttcacaaatgaggagaaaaataatctccgcaaggatgttactattcatttccggtggatccgccagtatgttaaaaacgactggtacgcatggaaggaaaagcagacaaataatagcaagcaagctgagaagggcaaatcaaagagcgcggagaaggatcagctgaagagccccctggcgcagttggcactcctgcgggataaattccccgatgctcacaagacatccaagacaatccagtctagctcgcctaactccaataaggaatcttcagaaaaaaagttgccactcggtgacgtgccattcctcaaggaggaatttacgttcttctgtaattattggcgggagatcgccgagaagctgaatgaggcgtattcaagggaagaacataatcgcatgaggcgggcggacattgcaaagcacttgaacgaactgtcaaaaaggcagatcctgccattcctctcggacttcttggccaacggcaacgacaaaaagaacgatgagaagatcaagaatctcatcgttaaggtcattgagtttaagaaggacctggagattgctaagaacgcctatcttagcgcgcagagctcaggcataatgcttgcacgggcaagctttaattattataccctgaataagaaacccaaagatttcgatagcgaagagaggcgcataatcgagaacatgaatgccaagtactatcagccggggaacattccacagatcattaaggaccttaagatagacggctctctttctattgagaaactgtatgaagagcttaagtcatacaaggccgaacagaaagccaagtttcaggaggccatttctcagggactgaagtttgaggagctgcaggcaaaatttcctctctttgaaactacgcaagaaatcttcaacgactatgtttccaaaacaaatctgattacgcagaaggccacacaaaagaacaacactccgaaaggctccatggagttcaagagactccaagacgaaattaataagctcaaacgcgaaaggggtaagatgctccagcagggcaagttccggaacttcaaagcgctgaatgaggagtttaagagagttgcggtgaagaagggcaagctgaaagcgcagttgaagggtatcgagaaggagaggatcgattctcagaggctccaatactgggcactcatcggtcaggaagagaataaatataaacttattctgatcccaaaggagaacgtttccaaggcttatacagaaattgtcaaccagcgctggattgacgacagagtctccatgtacctttactacttcgagtcttttactttccgcgctctgaggaaactctgcttcggcgtgaatgggaacaccttcatgcccgaaattaagaatgaactgcctaagtacaaccagcaggacttcggcgagcacattttcaagaccgaagacgggaagggcgacgagaaggccttggtggaattctatcagcaggttctcaagactgattttgttctgaagaaccttgctctcccgcaccagcagatggaggaggttacaactaccacattcaaagacctgaattctttcaagattgctctggagaagatatgctacaataaaaagatggtcgcctctccgagggttctccgcaacttggaactgtcttatggcgcagaaatcttcgagctctcatcacaagatctcctcaaagaacactccactaatttgaaaaaccacacaaaaatttggaatctcttctggtctaaagagaatgaagaaaagaacttcgatacgcggctgaatccagagatcggaatcttttggagggagcccaaggcatcacggattgagaagtacggggaaggaacggcacactacgaccctcagaagaaaaaccgctatctgcaccctcagttcacaatcgcattttcgataaacgagaacgctctttctaacgatttgaactacgctttcgaaggtttcgagaaacagaaggaggctatgatggagttcaaccaaaagattaataaggagttcaaagacggcatggagcagaaaaaattgggcgcgtttggtgtcgatacgggggaagcggagctggcgaccataggtctcacagataacgggaaaccttttcccgtgaaggtcctcaaggtgaaatcagacaaactcaattattcaaagcaaggctacttcaaagacggagcaatgcgcgaaaagccatacaaggctattgacaacctgtcatactacctgaagaaggatctctacgataagacattcagggacgaccacttcgagcagacgttccgcgagatattcgaagagattgaaacagaaactatcgacttgacttccagcaaattgatatgtgagcatatagtggtcaatggagatctccacactcgctcaaaactcaacatcctgaacgcaaaacgccaaattaggcaagctctgatcacaaatcctaatctggagatcaagtttgaggacaataaaatcttgatctctgagacagatgaggagaggaagaagatcaacccttggaaggccgtgtatcataccaacgaagaactggaacagataaagtacttcgaggcagtcaaagaggagattgaacagtacctcaagaaggtccaagacgattcagcagaggtgctccaaaatattaacagatttcgcgaagtggcagcggggaacatgacgggggtgatcttccacctttataataagtaccctatcctgatcgcaatcgagaacctggcccaaggcaccatagagaagcaccggctgagatacgaaggtgttatggatcgccctctcgaaagagctctttatcgcaaattccagtcgataggcctcacgccaccggtttcggacctcattgctatcagagacaacctcactcagaagaaaaaggataaaatgtcacaactcggtgtgctccaatttgtcgacgaacagaatacttccaaaacttgcccacactgtgaaaagaacgcatatgagggcgagcgcaagaatttgtacctcgaagagaaaaaaaaaggcattttctcctgtgggcactgcggataccaaaacataaacaacccaatgggtctgtcgctgcactcaaatgacgcagtggctgcctttaatatcgcaaaacgcggtataaagaacctgaagaagtaa

SEQ ID NO: 222 - protein, 1031 aa, Unknown
  metagenome-derived sequence
  MISC_FEATURE (1)..(1031): Unk46 Cms1
  MISC_FEATURE (38)..(38): Xaa=Ile, Leu, or Val
  MISC_FEATURE (387)..(387): Xaa=Ala, Val, Glu, or Gly
  MISC_FEATURE (410)..(410): Xaa=Phe, Ser, Tyr, or Cys
  MISC_FEATURE (798)..(798): Xaa=Tyr or His
  MISC_FEATURE (876)..(876): Xaa=Asp or Glu
  MISC_FEATURE (899)..(899): Xaa=Gln, Lys, or Glu
  MISC_FEATURE (924)..(924): Xaa=Asp or Glu
MNHPIQKNFNLFEVKKNISFVLEPLFEPSTSFEEISNXKTDIKSFLHKYDLVTKIMYWILLNQSSMKLNDKLKIKFCFLKTHTKDAYFKYGIEKLKNKHKNQIEMSSSELDYLIEVFQNFFQDNFTYSENLKQLLSQTSLQNPDIKYYFHKIASKANFDFFCDVSHSINTEIPSTYGKITAIKEIIKDLEMLKYKIQNNLHQEQSLWKTIEISNLNYFLANKKSKNYNELILNKENSLYHHIFAFPKFHAAKEENGLKDFENTYSLSYSHSSLTETYELLKEYKSSQKEWFLQFIQQWHWFEDLQNHVSFTFKSDHFEPNEFSLTLYLFDDISSENFEMIKTLSDKINFLIDIKNNSEKLLSCQQEYKDMFQEECFIWENPYETSKXLTKKIIQLKKESGTFFNTENQSXMFKKYAYFCAEYKKITLEIGKIKAQIKNLKDEQTQVESTNSWALILEKDTQKFLLTIPSEKANNSYFEKESNILQASNFIQWLSHQNNDYKLSHFESLSLKTLDKLCFAKESSYFSNKIAKELYQVNSDFVEKKEFIKFGKTVETYNIKMKYELPKTISWETCKKTLLNFYQSVIKLNSLKEQIMIENTQHFEQFINKSFENLIDFEKELKQICYIKQSIFISEASKESLIQNYYGNLYKITSYDLEKSLKSKNLKTHTKIWLEFWSEKNTWEKFPISINPEIKINFIKKDDSLWENSLNKKTNSKLNDSYLLTTNITQHACKNSWFINEKTKKEIIHFYENFNSDFESKNPENHLNHSYFIDIWENNSIKLSLYDNKNNSPIEIKIXNLKEEYFLQTNEKSTPAYKNISYFQYDSFQKLYDVESVQYVDLSTAKLVNEKIYLWGDISTYLNLKINCAKKKISQLXHWKISVSETNPNHIILTGWALPXTTIYNFDESYKTIQSKESIIKELEXFLEAKNIDSYFPENISIENINNLKNALSGNIIWIIFFLQSTYPGKIIISNFITKESMSCPDGLDKQIEEKILQKLSSLSLIPSNYKHILDLKNKNVLNKLGMVEFVN

SEQ ID NO: 223 - protein, 1160 aa, Unknown
  metagenome-derived sequence
  MISC_FEATURE (1)..(1160): Unk47 Cms1
METYKVTKTIRFKLEAQNVPEIQKDIEGLQSEFNLANFVSDLKNYLDQVRNYLFSEGKEHVFVNNKITIKREWLQNHAKQEWVDFLEKNKRNNSLNNHTRRIQMSIGDFTGLASKIEGTFDEINSICKGLADAAGAQANKRTKRERTGLLLKRLQARKALPSLFSLIENSADKNETGNLSLQLKNKSILIEQQLAAGVQTFLPAQSGGLPVAKASFNYYTINKKPVDFGNEKSELESRLKISIDTIFKLTRENFSKKIEEAITADIQKELNNGKTLLLGDVPMLGIENYVSLRQILKNIKSNQKKAFSDLMQSGKNYNELKATNLYLLNTIEQRQFDNYKVKTNELEKLAVKINQATNDNQKKELISNKQRVAKQRGIIMRDNFATWKSFSNFYRTISQEHGKILALLKGIEKERTESQLLKYWALILENNGQHKLILIPREKAASCKQWIASLNPSGDKLTKLFWFESLTYRSLQKLCFGFTENGNNKFNKNIQNLLPKDNSRKIINGEFAFQGDEQKKIKFYQSVLESKYAQSVLNIPIQQVQADIINQSFASLDDFQIALEKICYRLFAVVEANIEAELLKNDKAQIFNITSSDLRKEAKDKIKSHTQIWKAFWTSENKQNNFETRLNPEITITYRQPKQSKIDKYGERSQKNNRYLHAQYTLITTISEHSNSPTKILSFMSDDEFKSSVDTFNKKFKKDEIKFAFGIDNGEVELSTLGVYFPAFDKTTYKEKVAELEKVNDYGFEVLTIRNLNYKETDYNGKERKIIQNPSYFLKKENYLRTFNKSETAYQKMFTEQFEKKKLLTLDLTTAKVICGHIVTNGDVPALFNLWLKHAQRNIFEMNDHIQKETAKKIVLKNQLDTDNEKLKFAEYISKEKEFGKLNDDEKMKYTKWIFEDRDQNNFTEVENKKFKRCQKIYGNYSTKAKAPVLFASCFIDEELQSVTDIFDVRHIFKKREDFYALKTEEEIKQLIDSYNTNRASHDISNEELDLKILNTKKALVANAVGVIDFLYKHYERRLGGEGLIIKEGFGTGKVEDGIEKFSGNIYRILERKLYQKFQNYGLVPPIKSLMAVRANGIENNKNAILQLGNVGFIDPAGTSQECPVCIEGRLEHTTTCPNKCGFNSERIMHSNDGIASFNIAKRGFNNFVKSKTDKQ

SEQ ID NO: 224 - protein, 1161 aa, Unknown
  metagenome-derived sequence
  MISC_FEATURE (1)..(1161): Unk48 Cms1
MTQQIEEKQSSQNSVWDNFVNLYAVRKTINFEFKPSISTKNRIEKIIQEESKLINAERNTIEIRNFFNNQIQENVKLTKRYFNENLENFDEILNKFKEITGKIKTKNNYENFRIYVNTDKIKLLGKDFRDCYLAMKKKKSWKYKGVNNTLKLIKFNDFLTICHLFDYNKDTKTNENEFEKLFSEKTELLIKKYEFIKKQLKDFLDVNNDVNNQAEKFITKPEILDRLKSMAFCLQEMIAVMNIFCDEGKNGSDGFLAFVEDLKGFRKLVLDKNCEEIIDEIIRQANHITNPKAFHYKFTLNFKAKNPNTQLSGNDTFLSEKKLQEKLKQEMDKLEANKKKKSDCQSYISKFDNFGEKKCTKDQWDLVLNKQGLPDDFAEAKKQYDEAKKIKKKSEKEISDNQNEKNNYAVINQLKAALRNSRNTHFGVLLKKDGNYYLALENKILDGKLKADNEYVLKKLENKKASCQLLSYESLTWKAVEKLCLLPTSSLNGKDEDMVEYWGKFCKSEIILEKKNDNDKRLLLDTEKIKTYLKKIVSDNSLSKFFDEKTFDECKSLDEIKKYFNDACFTNKWVNADWEEFLKLDNEGKVDLYQIFNKDFELDEKFATSENDQQIIERIKKAKENLEKKFVPKHNNTERGKSLFTIYWQNCVNDLNVDKYRLQPEGKIYIRDKSPIQKSKRYQEKKVLGDFGVLFNPITKEIDQSSRDGKTRIGNFNNYLNKYSRDEICVIGLDRGENNLVSYGLVKFKKKIMEDSDIKVRFDNEIANECWALDEIVEVRDLSAVKVFNKNGNWEKSEFVKQKEDFYFTEKNGTNYDEEKNKQSAENKKTELKNQYPNYKDGKERIVIIPIRYKPKKDEEFQKTGAYAVKILSWEEQDGSVYNYRVAQEVLKENRLEQIEKNKDTELFETEKFKNGYVSALVGFIAEKVKKYNAFVSLENLNINKAKQGNYEKTFGASVYQVIENGLIIKLGYLILKNNPQNYTQLVPEIRRIEELKKGNDEKDRNYQLGFVQITDETNTSKICPNCGYSKNRLESANTANGMLKLSLKTISLKNDDFGIDDSKKKNFLVDNKTTAYKYAQDGIICEEIKSGNSDFAKTFCDPRQNMTKSKDFIRCAHCGFDSRFPHNNCKKLEKITGGDTLATYNIAKRGLEFSQEIKKT

SEQ ID NO: 225 - protein, 1000 aa, Unknown
  metagenome-derived sequence
  MISC_FEATURE (1)..(1000): Unk49 Cms1
MHNMQYEYTRTIRFNLSGEKVSYMIDVDAARSLEETLANLLIAYRDLLGVFKKAIFYEDKEGVLRVKSRLEIKKSWLRQYARKAFYSLPEVIRGRGSKFPAKDFEGNFLDWLQRSRDIYMDLTDVVSRPENDKIKRSDISTYIRLLKTSEYFPFVEKLLRPWIANDKDTNEYLDALRSIVERFGQLLDQALLVVSPDLTQGVEIGRASFNYYTVNKISRNFDKDIDDIRNKLESPFSGSLDKQFLEKVGFRKDSSRIPIQELYEDLKRFKAEQKKSFLEATQADVLFEDLQVKYPLFKLKDDQTLQKFKGSNPQKRGDYYRNNWGFSDYKKYCDNIFKPIAIKVGKLKAEIRSLEQEQVDARLLKYWAHIVQKDGRHLLLLIPKDAMQRAKQFLEQLPSKHEGESMLIGFNSLTLRALNKLIRRNLEREQTRLQDDAVSLYQEVLKGQHQRIQLDFNGFEQEIREVASGDYANEESFRIALDRVAYVQSKAHINEEQMAKLQNDFGALVLDISSYDFERTITSDKKEHSQLWEAFWDLKNQNNQFPVRLNPELRIFYRPQRDQEDIRKQKNRFSKNHFGVAFTITQNATQNRMETAFQEEKALLKMVQTFNHEVIGTFVEEKGENLYYYGIDRGDMELATLGVVQFSQERYEAMLAEGTVQIFDTPVFPLVETYRIKEEHLHDTKEIAINSTGKTQTITLFKNPSYFIEEEDKFEKGISPFMDLTTAKLIRGKIILNGDVMTYIALKKANAKRQLFEKLSKIDTNAQIEFDEIKKQFKIKSKDSEREDCQWLPFYSEEQEKVFPREAMRKELQEYLDKLRADITPEEGVSVEKINHLRDAITANMIGIIAFLFEKYPGIINLENLHSKDQIERHFSNNNENIARRLEWSLYKKFQKSGLVPPKLRQTVFLRENETEEGKKLNQFGIIHFVPTKNTSANCPYCGVSVPMKQREKDKFEHHAYICRNNSQNCGFDTRNPKQPFEYIKNSDDVAAYNIAKSKI

SEQ ID NO: 226 - protein, 1143 aa, Unknown
  metagenome-derived sequence
  MISC_FEATURE (1)..(1143): Unk50 Cms1; Xaa=Gly
MTLQNLTNLYEVIKTLKFELKPSINTKERIKFDNIKDLKLLENPSELLQTTKELASLQRSIFXIIFNLGSENIIIHKNLIKIIDSDVFYYFKNKQLSSIVSLSEVIKSIPEFSNTFDXFIKNIEDNLSKNIHKFESYILNIEKVYTKTEIXFAMKQYSLQIQKSHEVISLFVYKTXKIDGELKENLKKYFSFEDLENTIKICSQTMKSYNPTIGFEIHKFGFNSKSINKKADVDSLQKQCEKLEEEMEKLEEHKIQATQIFDAYTKQFNDYVIHXKERDEKTWXKVSEKLIPXDPKLEALKNNQTSSIQEIKEAKEYLKSIRDXNFDYQKINIAKNKFKKSLVFVDKIPNKKKENEYYCFXDNIYWDLKIKKTKKSIFYXKNKXDLFAKQTELFNQQKLTHYARLLRDKNNFFVAMVDRDCILELENIKEDKDIKEDFLKIMEYSSLTSKAVEKLIFERNVLNFDFKDEQFIICKKIRETRSYKEKXSTETQAQTLEEKQKLIQLVKFMNDAIXQINEKIENSVFDWKPFVIKDSFDDFEEFRKYITKSCYQTKRTKVSKDKIYELDKKXKINLYQIYNKDFXVDPYFAITERDKNSNFIEKKQKPNLFTIYWKDLFEQNXENIRLNPESKLYLRPSKKIEDIDXNNCDYXASKLRFKHNKIIADFQLVFYPTKKEKLEEIQKKIYNEIKEKTFSVXIDLXENSLATICLIDDEKRVVLDQNXNPIIKDLTLVNNKXGFVDIDNCFIENENYKRKDKLFIENDXSYFLTDWYFSSFLCQKPIKELSKEELKNVLIELEKMSPKELKITDTNXNKVFDYRYAFVYKQTENKIRYHLQSIGLNEEEKKFKELELMDTTRIKSGYVSKLVSYITDLAKEYNAVIVFENLDQKASYIKXITLLSEELFENVSSKEKSQLTXISVYQNIQNKIIRKCNLFMQKTGINTKLQITPKFKNIEEFKNFNMTNKDKNVXRXNVIFINEENSSKECPNCXFIPDTNPKIKDCKIVYKYNXEEKELNLDDEKIKDRKEYKKIXDLMQTRIKYTDLSKSXKWYIDXDPMVCVNCGYDTRKEARVKKHNLKSCDEIAAYIVAKRXLEFIKSQKVVESISQKQINNEKIEIHKNQKNNGFINEESTISGNIVFSXNI

SEQ ID NO: 227 - protein, 874 aa, Unknown
  metagenome-derived sequence
  MISC_FEATURE (1)..(874): Unk51 Cms1
MKECKSFLKESFQVDTDKNPHFKLYAQLIHLKEFLSTLESARPKDTQSIVKETQNLLSQINWDALGKDKNDKRTGNDYKISISSWLELRPKNDEKFQKAKQQIGLFRGGLKNKIKNFNDLTQAYKAVAMKLGKAFGDMRDKITGAAELNKISHYAAIIEDKNADRYILLKKSQLSGGSQKPFQSNDSGDLLIYTVNSVTSAAIGKMLRKMRAEELKKNEKNRQPLPELTDEKKEKESIERWKSFIKEKGWVSEFELNLDNKTFEQIKKEVDSKSYSLDVGRLSKNALEKLIHNEECLLLPIINQDLASEGKIAKNQFTKDWQRLFADEPQNLRLTPEFRISYRQPTPNYPDPGEKRYSRFQMMAHFLVDYIPKIDSYISIREQTETFKNPEKQKKAVAQFHQRLNPKSKSESDPIALLSAKFGSQINKNQGRKASTEEAKQKEDFFVFGIDRGQKELATLCVIDQDKKIIGDFEIYTRQFNAEKKRWEHSLLPERRHILDLSNLRVETTLSIDGIDQKKRVLVDLSEVKVKDKEGNYSLPNKMQTKMRHLAYIRKLQFQLQSNPDGVLDFLSKHPEKENALDNLLDKEEDEKGLISYYGAGNASEDLPKEELWNILVNFRELKNQLQEDPENQALDQELRALIELEPVDNLKYSVVANMVGVIAYLMEKFNYQVYIALEDLTNPFAPTTVSGITGVSNKNRQGEGKKSDVEKYAGLGLYNFFEMQLLKKLKRIQQENGNVLHLVPAFRAVKNYENVIAGKDKIKNQFGIVFFVDADSTSKMCPVCESTNDKQPNKSKYPEAKKEKSREGKEVWVERDKFNGKDRIRCYVCGFDTDKDYDENPLKYIKNGDDNAAYIIATLGIKGYELSLADLNP

SEQ ID NO: 228 - protein, 1145 aa, Unknown
  metagenome-derived sequence
MSELKFLGDYSYNKAIRFKLEHKCGELPKFESNNSNPLDLIDLGLKIVDDFKDLIYLKTEKNELKLDKNKSPILTKFVSIKKQWLRYYTKLEFYDGSKNKSVDFSITNFPYLSDSFKKWIVDWTDAINHLNNLLQDKENLMIRRSEIAYYLLLISSKNYFNYIKDFSFYSNDKNTTKVAEFQKLILIFEEKLNSCVIKYAPAQNAGLLIASGSMNYYAINKKPKDYDFELSQLKKEYEIKQEEYNLFKVYKSTQKSLLFQYINSGLDKDEILKKLADNYNFYKENNKKIKTFYSGDSGNDLAYKYSRLFADDRALTSIINLTDKINELNLKLQTTNNNKDQIKLEISALKQKRGFYFIKRHPRKSGDPDFYISNEKNWHDRYTFCFSNYTNFCKIFKVIAQKTGKLKAKIRAIEKEKIESQTLKYWSFVVDRSDEKELWMVPKENRTKFKDLLKSDNSTDVNIYQLTSLTMRALNKLCFAEESSFVKDMPDYLKDLQKKVKEATDDEQKIKNQRKKINFSTDIKTKSELKLSFFKELIKSEYAKSLLDLSKFNLEDLQKVKDLKEFEMLLEKNCYVLEKIGLSKESCEKLIKECNILIFKITSYDLEDRPKNTYQTKESDYKRITSEIWNTFWENPGINLRINPEVKIRYREKNEEHIKYLEEKGFDLTKIKNRFIVDQYTCYFTFTLNPGKLYPELVFAKTEELIKKIQEFNDQFNKINLEGTYKYGIDRGSIELSTLCLAKFDKNDVYTYTVDDKTKTILKPKFPNGEEDIKVYELKKELYNKKAISDLENLPMEKRKPKRIIANISYFIDKINDPNWFNKKTVTCIDLTTAKVIKDKIIVNGDLLTFLKMKKEAAKRVLFELVSEGKITPDHKELKWGSENLEDPSSRELRYYPYTSDKIVYHFENNFGRDLEGLLIKDDLIYSKENVLSNFQVYLTELLDNKLADKNEPNTHTPTIPKINNLRRALVSNMVGVITYLQKYYPGYVVLENLKSSEELNKFERNYINTSIPFEKALIQKFQTMGLVPPHIKNLWEIREEKTKKNLLVNKQNFQLGAILFVNKDRTSKDCPYCEKPYTWDKEKADELKFKLHQYKCGPDPSCGFDTKELLPKFDFLKEISDPDKIAAFNVAKRWKDIVENDAKK

SEQ ID NO: 229 - protein, 1174 aa, unknown
  metagenome-derived sequence
  MISC_FEATURE (1)..(1174): Unk54 Cms1
METYKTTKTIRFKLEADDKNIPYIKEDVINIQTNNNDFNLTDFISDLNIYLENINNYLFVQKKDGIFSINEKMTIKNAWLKQYAKQEFVAIKERTNLESKRREQVKIGDIRELISKIEKVFDFVDQTYVSLIDNIYSELNERAKKAQIGLLLKRLASKNALPLLMDLMENTSDKEETTDLSIRIKSKSSTIRSQLQAAIQMFLPEQSSGLQIAKASFNYYTINKKPIDFKEKINKLEDSLHIKSMESINTFFNRKKGKQDFYLKKEIFDLLNTDIQNAFLEKQTSCLFLGEVPMIDKEYVSLRDILKNIKAKQKKLFNELMQNNSSHNDLKNSELYLFNKISKELFMDYLNKTEEMEEVGTELSNHHLREEDKKRLRSKKARVTKERGSIMKDNFKEWKSFADFYRIISQKHGKILAQLKGIEKEEVESQLLKYWALILEKENHHKLVLIPKEKAGECKQWIEKVNEITKLNNEHAKIFWFESLTYSSLQKLCFGFAENGNNEFNRNIRHLLPKDERGNPINGEFAFGGEEHKKIEFYKNVLQSEYAQQVLHIPIEQIKNEIILHTFNSLDDFQIALEKICYRRYVVCPPNLEDSLEHFKAQVFDITSLELRNSKKNNLKSHTQIWKDFWNSENEINSFNIRLNPEIAISYRVPKASRIEKYGAKSQNYDPEKKNRFLHPQFTLVTTISEHCNYPTKVLSFVNDDEYTKMVDSFNRKLQKENVKFAFGLDNGEDELSTLGVYLPEFEKATIEEKIAELKQSQKYGFEVITINDLNYKEADYNGKERKIIQNPSYFLKKENYMRTFNKSEQEYEDMFIKLFSKKHTLSLDLTTAKVICGHIVTNGDVPALFNLWLKHAQRNVFEMNDHTADETAKSIRLRNNEELTNNEKLKFAEYVSDIKKYEKLSVDEKTKYLKWIFEDRNNNQFTDEEQKTFNDKYLKKKGNYNSPIIFASRFEGDDLQDVTPIFDCRHVFKKKEEFDAIMPINDIVTLIDSFNTNRSNHNISNEELDLKITESKKALAANAVGVLDFLYKQYKHRFNGEGLIVKEGFDTQKVGEDIEKFSGNIYRILERKLYQKFQNYGLVPPIKSLMTVRSEGIKDNKNAILQLGNIAFIDPAGTSQECPVCKEKSKKKHTDNFDCQCGFYSKGIMHSNDGIAGYNIAKRGFENFKKEKQ

SEQ ID NO: 230 - protein, 1228 aa, Unknown
  metagenome-derived sequence
  MISC_FEATURE (1)..(1228): Unk55 Cms1
MEPIKNEFQLLKALGFGLTAKHSEKKNKTHEELMDLIQLSEERIKGKTKPTNEITEKKMLEIISECVFLMKHHINTWEKVYNRADQITLTKEYYKELAKKACFDAFWTDNKDNKQPKSQLIKLSSLKKPRYENYERMGYILRYWRTNIQNLKRKIHDFELLLSQYKLALSKQDKAHTKPQLVDFRKMFLSIVALIHETLIPLNNNSIQFLQLDKLPDGEDSETVKTFAIEEREERKYLAAKIKETKEYFEENGGYVPYGRVTLNPYTAKQRPHIFNEEIADIIKDLGVEKLIKKLQSINDISKYFEFAESDNDKRKLMKDSSYSIIERVQFFKYKPIPASVCFMLADFLQRTKKLEKENVLDLLNKIGMQRSISKEYKDKKSINLEQYPLKIAFDYAWENLAGRIHNSTIPFSDQQCVDFLQQFGVDINNDNFRLYADLLFVKNNLATLENPKNQPNDGSEFIDNIKRTFENIKLSKENNKHKDVILNWLNKNTEEQKELKKGNAQLFKDYEKAKEKLGQLRGMQKNSCPKYKSLTEEFKNLAIDFGKKFADLRDKLREESELNKITHFGVIVEDSQKDRYILLGKPEDKLIHKFLNNDPNGNLKTYNVKSLTSKALSKIIKNKGAYKAFHSSQVKIDRKEIKQKWQEYQDHGDFINYVKDCFANSPMSKEQKWSEFQCKFDHCQKYEEIEKELDAKAYLLKEQNISLQTIKKLVEQEDCLLLPFVNQDITSKTRERKNQFSKDWDMMFKKDNGYRLHPEFRIFYRQPTPDYPKSGEKRYSRFQMTARLLCEFIPQSDNYISHKQQIKTFNNKDKQEEAVKEFNDKLHHPDNFYVFGIDRGINQLAVLCVLNKEGQIQEGFKIYTRSFDIEKKQWIHELSEKRNILDLSNLRVETTINNEKVLVDLSGIKIKNKEGYQDNRQKIKLKQLAYIRKLQYQMHAAPQRTLAFINKYHTPEDMKKHIQEDIKELITPYKEGVNYSDLPIEKICDMLQQFKQYYDKEDKKSTRELTELDSADELKTGIVANMVGVIAYLLKEYDYKVYISFEDLTRAFGRQKDGLDGRELPHSNEDKTVDFKGQENAALAGLGTYHYFEMQLLRKLFRIQQENKDILHLVPAFRSVDNYEKIVRRDKKSDNDEYVNYPFGIVRFVDPRNTSRKCPNCGEIKKQIITRSKNKITCRKCGFITGNNNHDKIKDNKKDKNLHYITNGDDNGAYHIALKTLKNLKGQ

SEQ ID NO: 231 - protein, 1210 aa, unknown
  metagenome-derived sequence
  MISC_FEATURE (1)..(1210): Unk56 Cms1
MEKDKITAISEYQTQKTIRFGLTATNQNLYSEEIMELLNVSEKTIKEQVEKVNNDIDKNNQLRYCLEQIKKYIETWDNVYYQIDFWAITKDYYKVIAKKAKFDFDKGNGSEIKLSSLQSAHNNRKRYLYIMDFWKENLYKTENLYRKSDNLLKVFEEAEKQNRNDKKLNEVELRRTFLSLFNLVNESLKPLIEGNLFIVNDDKIDEQNSNHKFVEDFISKTDERKQLYDCITELQKFFNGNGGYVPFGRITLNKWTAQQKPHIPKDKNGNNEIDKIISFLKPESVSMQNIDYEYDAFEDNFEQIDNKWKLKQNAKSVIEICQFFKYKKIPVNARLNLAKRLNKDIHFLSDFGVSKSPALDYKNDKDNFNLANYPLKVAFDYAWENCAKAKYETITFPEQKCKDYLKDVFDLNVDSNTDFTKYALLLRFKILVGRIKAEENTRKENIETVRSLLKDVKDNLSKEKDKTITSVENWLTFKEKQTDKKEKYENQDEFSKVMQTIGQERGGLKSRISKYKTLTEMFKVCASKFGKQFADLRDYFNEAYEVDKIKYRAWIIEDGKLNRFVLLADKTKDLNLENDKNGNLKLYEVKSLTSKSLVKFIKNKGAYPDFHIVNNRQIYLNSGGKDNRGNFIDDVKIHWSIYQNNQKFLNKLKDCFQNSKMAIDQNWNEFNFDFSNCDTYEKIEKEIDRKGYILQQNSISLDKVKDLIKNQECFLLPIINQDINREDKQAKNQFSKDWNDIFVNTKRLHPEFNLFYRFPTKDYPNTKFKNGTEKTKRYSRFQILAHLGCEVIPQGNYLSKKEQIAIFNDDEKQKGEVKKYINICSDFDCVIGIDRGIKQLATLCVLDKNGSIQGDFKIFTRTFNHDTKQWEHHFLEKRNILDLSNLRVDSPITICCNIPDDNHKKVLVDLASIQTKNGENQQKIKLKKLAYIRELQYAMQTQDLSEFVNSLKSADDITQDKIKNFISPYKEGPPYADLPKQEMFDLLKEWENADDEEKQVIAELDSADNLKSGIVANMVGIVAFLCEKYNYKVRIALEDLTRSYGIQKDALSGTTIFQNDEDFKEQENRRLAGVGTMQFFEMQLLRKLFKIQVDKNLHLIPAFRSVANYEKIVRRDKQNSGDEFVNHPFGIVCFVDPKYTSKRCPKCGKTNVDRKENIVICKEKSCGFQTKEGNPFEKNNIHFITDGDQNGAYHIAKKVLKKDSNNETKK

SEQ ID NO: 232 - protein, 1148 aa, Lentisphaeria bacterium UBA7640
  MISC_FEATURE (1)..(1148): LbCms1
MSNKMTYQYTRAIRFKLNNPSKTGFYHPPENKKVDLNDLLSKTDSVKNDINDLLFFDGKIQKKLEVKKNWLLLHHKNEFIFYTKNNRSKKYKLSELNLNANDENYFKNRLGILLNDWTHYTSILADANNRPDESLIRKSEIANAVRSLLNKHILGYLIDLLNNLSSSNDYLLDGKCDELKNKLCSIREYLQFLETEYLASQSSGIECARASFNYFTVNKKNKEYFDNQIDEIQKEQAQNYGEIKDNKLSVIQRGDIIFDFKTEQEKQWLKLYLGKNDINDEKLTKQQTVTLLANFKSDQKSIFHEVLGHSHSDAKNTIYTNNNRKLSIGTSNISYKSITQVSDLESQFSLFNLKGDKKTFDKLLNPHKGNKNVKHFFCGQNPYFHLFKKYCSNFADVAKENGQLTSQIKNLEKQRLESQRATYWAMIYKKDESVKLLLIPRIQIMDSRKYIDSLKQAPNGNLFVLQSLTMRALEKLCFAEESTFVNDMDAELKSLQKKIKETVTEPTSHEKKAGSVDKIRAEKLANKLMEKLKFFKKVIMAQYTRDRIDLNHFDLSACQTAEDLNAFELELEKACYKFTTYKLSEQEYDKFIQDFDIQTFDITSYDLEGRNKSSAPESADRKFTKIWNQFWNNESNNEFGTVRLNPELRINYREADYNLKQFFEKKGFSKIFKHRRLQEQYTVTFSFALQAGNIYEDLSFVKPEDQIDKINKFNNQFREKMPYDSAWKYGIDVGQIELATLCLTRKTDQFYSANNEIFCKYEFPEIEIYKLKDLNHNENYDTKTETNKIRYAIKNISYFIDQVELFEKYTTATIDLSTAKLIKGKIVTNGDLISYLKLQKLVAKKRVYEIFHRDQIDYQDTMFIELSDLKYNHNGREKTPGELHVSVIFKEQENTNQKEGRTVFSFRKEWANLTGYTTADIENSLKIYLSDIQTLTKQRKSDKRLGKDVRQENLHTPTFEQINNLKQALVANMVGIICHLQETYPGYIFLEDLKKASIDNQFNQNNSHIARKLEFSLYKKLQSLGLVPPHIKDIVALREVIRKKDDKFNCQFGIMIFINEENTSKTCPYCRKKSRKDNVKKMQKHAFDCDPENDSASCGFTTCSTKKEFQFLKSIDNPDSLAAFNIASKIDDKDLLIRLSLPVRHGKR

SEQ ID NO: 233 - protein, 1219 aa, Unknown
  metagenome-derived sequence
  MISC_FEATURE (1)..(1219): Unk57 Cms1; Xaa=Gly
MKNFTNLYEVRKTINFEFKPSFSTQKRVLKDRIKEISTFKDEDKHIIDIIDFFNNKNQEAVIQTREYFKNELDFFDTVFESFVQIMNKIESKKNYENFRIYVNTAKIKLFGKDFRDCYQEMSRARTRKGRGWDYYYSFNQGTQKPEFKTVRFGDYITIHHLFAFQYDKETKIGEFEKLFLNKIKLIKQKYEYSKIEILDFLNTKNQTEKFITKPEILDRLKNMAYCLQDILKIINIFCDEGKNGSNGDASFLKDLEGIRKLLEEKNIEEVTTEIIRQVNQIINPKAHHYKFTLNFKAKNPNIQLSGNDTFLSEQEIQEKLKTEMDNLEKNKKDKSDCQSYISKFENIIDEILINEIFKNKTKFIDKINNNKKFIDEAWDKVKNKQGFPDNFEEVFLKYKTNIKTKKSLDTDIASNQNERNNYAVINQLKAALRNSKNTHFGVILEKNKNYFLALESKILNKKLKADNKYILKNLENKNNFCQLLTYESLTWKAVEKLCLLPTSLLNGKNDEIIKYWSKFCKGEIITENKKDGDTRDLLNIPKIRKYLSEIVKQNKLSKFFNKNEFEKCVTLDDMKSYFDDNCFVNNWIEADWDEIYKLDENGKIDLYQIFNKDFELEESFATSKNDKEIVKRRKSAQEKLGNDFVSKQLNTKRRRTLFTTYWSNCFDGFDTEKYRLQPEGKVCIRNISPINNSVRYTEEKVLGDFGILFNPITKIVDQSSKKGKERIENFNSYLQKSIPKDEMYIIGLDRGENSLVSYALVKFKKKRLETDDISVRFDNEIGEKSWVLDEILEVKELSAVKVFNQKGKWKKSEFVEQKEDFNFVQKTGENYDEELNKKNAEFKKEELKKQYPNYKNRKGEDKERVIIIPMRQKEKEKAXVRQIKTGAYSVKICSWKEDDGSIYNYRVAQEIIKEERFRQRKKQKEDNLIDTEKFKNGYVSNFVNFIAAKSAEYGAFVSFENLNISGGKDGNLEKTFGASVYQVIENKLMSKLGYLVQKSIPNNHLQFVPKIKRIEELNKDIVSENNKNKNYQLGFVQITNETNTSKLCPNCGYSKNRYKSAEIEDEMINLELKDLKLQNEDFGINTFKKIKFQIDNDIKAWRYAGVTTEGLDLNHKDFCKVISDPRQNIKKSKDFIRCVSCGFDSQFPEKNHSKFEKINGGDVLAAYNIAKRGLEFITQKNQSXPSSILHAIILHKNWISIKFXLNSLLFINKKICYNR

SEQ ID NO: 234 - protein, 1194 aa, Unknown
  metagenome-derived sequence
  MISC_FEATURE (1)..(1194): Unk58 Cms1; Xaa=Gly
MQEFKNIYEIRKSLRFELLPTNNEDILKPKNIDYDLNEFVEKLKDFLYKFKNTIFYYSEEQDIEKMNFRKXLEIKYVWLKNYTKNDFYNXTKKKDKTYKLNEIIYLKKYFFYFFDELYEIILNLEEIVQLPKENQGRKSNIAYYLRKLNKKDVIDFIYDFLKYIHNPQNPKTDKFLNDLKEQIENIKNTLLELNKQFLPLQSSXLEVAKATFNYYTIDKYSKINFDKQIENRLNELYKSIFKLNNHRLFKVWINKEKRNFTITNKFLEKIXFFDYLEKERNFLNFLLSKLEINKEEIENKIKILDKVLVNKDFKVLNLDEAYELIKEFKANAKSHFTSDLXAFEFRKFKIPYSKITKENKKDNIEGTLEINYENFLNIHPLFEISDDDFKKLKELTEEINNYSLKKNNILQKLKLKKSKLEAQIKSKQKENXELNKEEKDFLEYDNKIXELTQKRXKYFNKPXEKVYSWNYFYINEFFKNIALERGRIKAEIKXLEEEKNQARLLKYWSLITEKDESKYLILIPKGNRXNVKEKLEEFXEEKNDVTIYYFKSLTLRALQKLCFKSREVNTFMWGKNXVAYELLQINLDKGYININKKXKKLLKRYDELKNEEQEVIQFYQDVLKSKNANKQLDLVDFGXLDEVLNKNYSSIEDFRIDLEKVCYVKIPKQISKEDYDKLLEKNNILEFEITSQDLRIQKENYENLKNHKNKEHTKKWLNFWSEENNNKNYPIRLNPEIKILYREALQEKKXDYKNRYTKEQFTLTTTLXFNIPSKKFDFSFNDTRDIKEKIDNFNNKFNKEFNXPWYYGIDRXINELATLTVVKWTDETYNTNXIQINKPEFAEIEVYKLKDENKKLKIINYKXEEKEVNIIDNISYFLDQENLFEKIITSTIDLTQAKLINXKIVLNGDKNTYLKLKKLSAQRRLFELFSKNLIAKNSQFEAXKKILFVKRNDNNYEPIYWFTEEQKKNKELQKDIIEELKKYLEDLENKNIFEDTETIEKINHLRDAITANIVXIIYFLQKKYPXKIYLENLETKAPQQETFSFKKXKSXDYTEIEEKMIDGHFRQSNTDISRRLEWXLYRKFQESXFVPSNLKQTILLKDEFKQYQFGIINFIKVKATSSTCPYCEIVTENKXXLKKHIKEDNNCKLKSNFQEDKDKIKNCIYKDLYNNYQINYDSIASYTIAKFGKKNLFN

SEQ ID NO: 235 - protein, 1268 aa, unknown
  metagenome-derived sequence
  MISC_FEATURE (1)..(1268): Unk59 Cms1
MINLESFKNLYEVKKTVSFWLNQPSKKSDINKTHWLLKDLVEISFESEKKLINNENNHVLIDTEKVLIEKLQQYVNWLEVQLKNWKWVYQSYDLIAINKDYYKILASKAKFDAMWEITKFDKKSNKYIKVKQPQASQISLSSLKIWNSSDSIIQYWWEISQKTDYLLNIFKPKLEQYEKAINDANSAHIKPDSIDFSKTFLQLLKLTKEFLQPLLDSSIIFELSKKKVSQEIEKISEFAWEKNNTKIYNVLKNWEELSQYFEANWSQVPYWSVSLNYYTAVQKPNNFDQEIKKAIDDLWIINFLKKSDSQMIDYLHQGSKQKIKLLLTSKHPYPIELLQLFKVKPIPFSVKYNLAKFIEKNYKNEISLSYEEILDKLNLLWSAIDIANDFKNSNNQNNFSLDEYPVKLAFDYAWENTASSLKSTIPFPKEVCKQFLKDNFDVDVDNADFKLYANLLFIADNLAIIEYNNPNNEVELINKIKQAFDSIDFSFDKESYWWYKNDVLVLLNKAKSQSDYSTILKAKQELWLLSWWLKNKIKKYSDLTQSLIDKKNSHFWIASFVGKTLAKISDRLKEENELNKISHYGVILEDKNQDKYLLILQLDGKDTSEKISQKLGNGDIKVYQVNSFTSKALNKFIKNSWSEDAKKFHWDFSYKHKEVSIYDEKGKWTWYQESFLSHIKKCLIDSEISSEQNWEAFGWNFAGCNTYEEIEKEIDSKWYQLTENSILKETLGKLLKDEGCSLFPIINQDISSQKQENKNIFTLDFEKVFEWKEYKIHPEFSIFYSKPMEEHEKENKSWIINRFWKLQLLANLGIEFIPSNSSFKTKKEQNSIAIDQKKQNQLVQEFNQEKVNTYFEGLDNYYIFGIDSWIKQLATLCVTDKDWVIQSFDIYTKFFDSKEKIWKYTKTSTEGVLDLTNLKIESDKNWNTYIVDISLFDAKDEDWNPTGTNKQNIQLKQLAYISKLQYQMSANEEWVLTFLGKYKNKEESEQNMKGLITPYKEWKNFADLPMDIFQEMFENYYSLKTDQNLSESEKKNLMKITTELDASESLKKWVVANMIGVIYYLMKKYEYKVKISLEDLSNAWFFSKDGLSWDVVLNTKNDETMDLKKQDNLALAWVWTYHFFEMQLLKKLFKISTEEWVLHLVPSFWSVKNYIEIMKIKGKYVYKQFGIVYFVDPSNTSSKCPVCWKWWKKYISSVDNIVTCKNCWFDTSSDNSILINNYEKQWKKLHFIKNWDDNGAYNIWEKISELPKKSDVKNTSISWNISFS

SEQ ID NO: 236 - protein, 1107 aa, unknown
  metagenome-derived sequence
  MISC_FEATURE (1)..(1107): Unk60 Cms1
MNKNNMQKMRDCKIPFELRKTIRFNLQPKILKRPHELTENDNDSLTEQIAKFTNEYEFVIQNLERLVFFTSEDGQKKELRKKVYVKHAWLRNYTKTEFYDGKDCILYNKNGIKRSNQISIADNNVKFLENYFTNWINENNECVQKLQRYLERPEYKQKRFSEFAYWIQKVLKRSNFEAIFELFNSNIQHKSSDKDISAIKKELVAIKPLLKSLTNELLPSQSLGVEIERASFNYYTVNKKPRNYSEEIKNKEQEKNKKLFSFNKQSKKMFILDNKIKFLKEDIRQLNDDYFVEEIFSKEKKVIKDFNHLKISKAYKFLKEYKANEKSRFYELLESGKTSEEIKAECPLFECSDKNFNKIKDLTNRIERTKDEDLRENLKEERGKHFDVVGEEGNMCSFDKYKKFCALFQKIAMQLGRVKANVKSLEKEKIDAERLQSWAVILEKDNQKYILTIPRDSWGNLREAKWFIDSLQNESSTEWKLHSFESLTLRALDKLCFGSDNTFSLAIKGELKIKNSVFFDGEKIKRKDQFSKDGLELIRFYQTVLELETTRKTLAIENFKGLAEVIEKDYENKEDFEKDLKKACYYKKTVLISEQTKNEIIEKYQGNLYKIISYDLEKDDHEDIAKLDNKKEFNRNNLETHTKYWLYFWTRENAKSNYHVRLNPEFRINFVEERTGELEGKQLGALNKNRKKNNKFLLSTTITLWAHEKNIDLAFKTTDEISGFIDSYNKKFNQKIKPFDIYYYGLDRGKRELLTLGLFKFSETEKVQYIMENGVVGEYNKPEFIDIAAYQIKPEKYLEKNDKGRVVYKSASEFVEDSDVVEKISIKSCFDMSCAKLIKDKIIINGDIATYLELKLVSALRKIYEGTTRGKFMSDNICFDAEKGALFLNIKNKGELKNEYLYFYDDRFKNILSLEKIKEELQNYYDALREKKAVEIIEINRINNLRDALCANAVGILSYLQKRYFGMMCFENLNLENKNKRISEFAGFLASRIEWKLLQKFQTLSLVPPIYKQAMTLQSNGKINQLGIVAYINTEGTSSECPHCGTKNSDKSDKWHSHAYKCKNTHCNFDSSDKTKRRGLVGLDNSDSVAAYNIAKRGLQKVVEGTV

SEQ ID NO: 237 - protein, 1148 aa, unknown
  metagenome-derived sequence
  MISC_FEATURE (1)..(1148): Unk61 Cms1
MTMVNLESFKNLYEVKKSAKFKIVPKKIFSQKEDSGSIYNTEDIVKQYKGIIKDLESILYYENFVPEAEPLSNKLWDLCDFSKFESELEENQEISSLKNKESSDLIRIKHAWLQKYFTNDWHENKDFIISKKLDRKSNIEIKTKNWTTIWSVNFLKEFFENFFTDANKYFNVISKLLQVQDFEKNSQSDIKFALQTIQWKDHLYKIYQLFEWGYIEHKNDNTSINELQEKLKVFKNNVNNYIENCSINDSFGLPLEYVSLNYYTSSKTQKDYDEEILKKSESLKKKFDWDLWELYWISKESEISDLYNNMKLFKANQKSAFLQLLQSQTPFSKLKNNFEYIDNKGEKYSDYKIQLFNDITEENYKEMKDLTSKIEESDNKQTSKALKEKSWKYFLFHCKKYNNFCDYYKKVAMEFWKSKAEILSLESEKILAESESWYGFLSKDASNNYYINTFDIENTKNAYDFFSNQSQKQWEITYYILSSITLSALEKLCFSKSSNFYKWNIVQKIDEKFLKIQEATGNKIFKSKSELEEGENLIEFLAEVLSLQNTLWIKFKSEKSLDKLKGCENISDFEILLKKETYILDEYKISKEDFEKALEKFKWNSFLIIDKDSDNHNKNSVFSQWWTSFWKKNNTENYILSINPELVISFSKWDEEKFKNKISFHSKKNDSYMLTFNFSHFSDKSYINSEFIDDIQSKENLESFNNLYNNNVDLDYFYWIDKWTNELVTLWIYKKNWGLMDSVKISEKIPVYKITNKWLAHFEYIVNEKTWKLVIDKDTWEEKKSYLSKNVSYFIKDLENKELFEQLEISSCLWDLTYAKIIKWNIILNADIFTTVNLYKVTAKSFLNDATFSGKIKNNTVLFDDENKSFYFEYENSWKLQKQNIFYWKDDFDYLPCDDIFQNLKEEVENELNMYLTSISNEEDISMQSVNNYKNAISANIVGIITELQKHFNGYICYETLDAGQIEQKWLNTFIWNTLNEKIYNKLQLSLEVPPILKKFSTDIWTKEIIQHWKIIYVNEKNTSSACPICNEQLLNWNLSDKKDDEVFKLWWHLSDFENNMKHLTDLDYQEWLKNKSFKKANTNKKWEIEKNKYNSWTINWKSCDYYIGNENYPEFEFIKSWDDLATYNIAKKAKEYLESLSKKEDSE

SEQ ID NO: 238 - protein, 1123 aa, unknown
  metagenome-derived sequence
  MISC_FEATURE (1)..(1123): Unk62 Cms1
MLENLTNLYEVIKTLKFELKPSKFTLKSCDFDKAFEADPHALFEKLKSVHKFQEQILDLLWKTSSKKIVIHKNLIKLIDADYFYQLKSKAISSNNTIAVLSQDFQEEFFNYIKEKFNSLHSTNYSLDYLLWADYLENPTTIDKKPTKSEIAFATKKYVHAIEKVEEILSNLIYKTWNIDSEIESLLANYYNNQDLKPLLKVAKSYLQSYSPTSWFQVSKFGFNAKAIQKKVDVEKMEQEIWSLEKKMLDLEEKKIIATQIFDDYAKKFVQEKIKSDPKLLALSENQTASLDEIKSAKEYLKYLKEWDFDYQKILKESSKASKEKKDSMIKFTWDSEYCELKLAKTDASVVYGSAKQAFFAKQQELYSQQALTHYASILSSEWNYFVAMIDSDDVSFLERLWTNDKVNNEKFEILSYASLTASAVEKLIFEKNALKFNIYDKEYKECKMIREKSSYKEKWNEDSRSKNEKQKENLKKLVLFLNSAIEQLNKKLEWWIFDWKPFLIWNDFDNFSEFQKYITENCYIASREAIDKQTIYDLDQKWKLNFYQIFNKDFSVDPYCATTESDSSSTIKNINLQSKKNLFTLYWQSLYTENSWTISLNPESNLYFRPSSVRTEIDLCNDCEASKLSYSQNKIIGDFQLVFYPTKELPFDQLQQKILKNSEKSYAIGIDLGENSLATICLVDNEKKVVLDGNNKPIIKDLSMINNKWDFVEVEDCFIDWKPYEKKQKLLIWGTETKPYMLGRHFPKHLQNKVIAEMSQDMLFEVLQILESLAPEKLWIVDKQWNKVFDYNYAFEHLKAINKISYHLQVFNHTNDEMSILEKDLLASIKIKWWFVWKIVSYITQMAKKYNAIIVFENLDQEIGSIKWSYLFSEQSYAKVSPKEESMYKGISPYQLMQDKIIQKCNYLLTKQEIKGWMQISPSLKSQEDIKQLTLLKDKNCAWGKIIFVNEEDSSKECPNCGFVPWKYSSNINIKDDWIELMANKKDKKVFSFAENQLLSESREAYQKISDIDKKKALLIETSVWKTFLKSYMDIQGDPMICVNCGYDTSKTKRVEKYNLKSCDEIAAYIIAKSWLEFMENKWYETQEVSISVGWDSYNKPSDGEQDDSCASGVKLSWNISFS

SEQ ID NO: 239 - protein, 906 aa, unknown
  metagenome-derived sequence
  MISC_FEATURE (1)..(906): Unk63 Cms1
MEKNYKSEINLSYEDILNKFNLLWSAIDIANDFKNSNNQNNFSLDEYPIKLAFDYAWENTASSLKSTIPFPKEVCKQFLKDNFDVDIDNADFKLYANLLFIADNLATIEYNNPNNEVELINEIKQAFECISFPFDKEVYKWHKEAILELLDKEKSQSDYSTILKAKQELWLLSWWLKNKIKKYSDLTQSLIDKKNSHFWIASFVGKTLATISDGLKEENELNKISDYWVIIEDSNQDKYLLTLELNGKDISDSISNSLWNWEYKTYEVNSFTSKALNKFIKNPLSEDAKKFHGKYKDEYSFWYENKDWDFTYKITKVSKYDEQGKWTWYQESFLSHIKKCLIDSEISSEQNWEAFGWNFAGCNTYEEIEKEVDSKWYQLTENLISMGNLKSLVKDEGCLLFPIINQDISSQKQENKNIFTLDLEKVFEWKECKIHPEFSIFYSKPIEEHKKENKSWIINRFGKLQLLANLGIEFVPSNPSFKTKKEQNSIAIDQKKQNQLVQEFNQKKVNTYFEGLDNYYIFGIDSWIKQLATLCVTDKDWVIQDFDIYTKHFNSESKKWEYKFHSKDWILDLTNLKIESDSSWNKYIVDISLFQAKDEDWNPTGTNKQNIQLKQLAYISKLQYQMSANEEWVLNFLGKYKNKEESEQNMEELITPYKEWKNFADLPMDIFQEMFENYYSLKTDQNLSESEKKNLMKITTELDASESLKKWVVANMIGVIYYLMKKYEYKVKISLENLSNAWLFSKDGLSWDVVLNTKNDETMDLKKQDNLALAWVWTYHFFEMQLLNKLFKISTEEWVLHLVPSFWSVKNYIEIMKIKGKYVYKQFGIVYFVDPSNTSKKCPVCWKWWKKYISSVDNVVTCKNCWFDTSSDNSILINNYKKQWKNIHFIKNGDDNAAYNIWEKIR

SEQ ID NO: 240 - protein, 910 aa, unknown
  metagenome-derived sequence
  MISC_FEATURE (1)..(910): Unk64 Cms1
MEKNYKSEINLSYEDILNKFNLLWSAIDIANDFKNSNNQNNFSLDEYPIKLAFDYAWENTASSLKSTIPFPKEVCKQFLKDNFDVDIDNADFKLYANLLFIADNLATIEYNNPNNEVELINEIKQAFECISFPFDKEVYKWHKEAILELLDKEKSQSDYSTILKAKQELWLLSWWLKNKIKKYSDLTQSLIDKKNSHFWIASFVGKTLATISDGLKEENELNKISDYWVIIEDSNQDKYLLTLELNGKDISDSISNSLWNWEYKTYEVNSFTSKALNKFIKNPLSEDAKKFHGKYKDEYSFWYENKDWDFTYKITKVSKYDEQGKWTWYQESFLSHIKKCLIDSEISSEQNWEAFGWNFAGCNTYEEIEKEVDSKWYQLTENLISMGNLKSLVKDEGCLLFPIINQDISSQKQENKNIFTLDLEKVFEWKECKIHPEFSIFYSKPIEEHKKENKSWIINRFGKLQLLANLGIEFVPSNPSFKTKKEQNSIAIDQKKQNQLVQEFNQKKVNTYFEGLDNYYIFGIDSWIKQLATLCVTDKDWVIQDFDIYTKHFNSESKKWEYKFHSKDWILDLTNLKIESDSSWNKYIVDISLFQAKDEDWNPTGTNKQNIQLKQLAYISKLQYQMSANEEWVLNFLGKYKNKEESEQNMEELITPYKEWKNFADLPMDIFQEMFENYYSLKTDQNLSESEKKNLMKITTELDASESLKKWVVANMIGVIYYLMKKYEYKVKISLENLSNAWLFSKDGLSWDVVLNTKNDETMDLKKQDNLALAWVWTYHFFEMQLLNKLFKISTEEWVLHLVPSFWSVKNYIEIMKIKGKYVYKQFGIVYFVDPSNTSKKCPVCWKWWKKYISSVDNVVTCKNCWFDTSSDNSILINNYKKQCKFFLHKKTSLFSLVFQIYHDNVPKCN

SEQ ID NO: 241 - protein, 1103 aa, unknown
  metagenome-derived sequence
  MISC_FEATURE (1)..(1103): Unk65 Cms1
MEKYQITKSISFRLNKVKAPILEEQVEKIGDVKEAEASLLRLFSVGQDLAGLLKQYIYKDNQKLKSSVTVHFRWLRDYTKDKFYNWKTESRRDFSREKRFKLSEVDYLKEVFEHFISDWDTIIQNLGSEISRKQEALSRKAEIGKIIKRIGTRNVFLFFENLIIESKDKNEIHLEAQLNEKIKVFKENLIKAEQWALPAQSAGIELAKASFNYYTINKKPKDFELEKRNLEKQLHNYDERFMKDIAQRENKLFGELRIIEKDDATNMYRFLYELIQNGEGKQVLEKTDKGLTVDLDSLYKNLKVFRAEQKKSFQEAVSKGSSYDDTAKINILFSSVDQKNNEKNLKAFNKYKEFTDTIQKLADQKNKVERDSLNSQKLQEEISRIRQYRGKLLFQGPSKRGEPEERFDKYLKFCKVYKDIALKRGRLVARLKGIEKEKIDSQRLKYWTFIVEKDKQHQLVLIPKSQSQKVYQKISSYESLGAGSSDIYYFESLTYRALKKLCFGVNGNTFIPEISEELRKAGKWNYEERDFGEHIFKIRSGVEEIRDEKRLIAFYKDVLGTDYIRKNREGGKIVLPSSFDEEVLIPEFSTEQEFHAALEKCCYLRKKKIPKDDIEKIFSECSAQIFTITSYDLEKQNKTNLKAHTKLWFDFWTGENEAQRFPLRLNPEIRILWREPKATRVEKYGKDSKLFDPKKRNRYLHPQFTLTTSFIENALHPEINYRFLDAKQKKENVKKFNMDIYAKLKPLPKAWYYGIDTGIVELASLCLIQKNGIPQTFEVLNLKEDKMNYDKTGYLKDGTKKKYKAIQNLSYFLNEDLYKRTFQDESFLDTFAEIFEKKEVSALDLSVSKIISGHIVMNGDITARLNVALANARRKIVDALIKNPSVQLSEQDYNIKVGDEIIFKGRIEFNAIKSWEDIQAIIHSSFEKDKENLARVQEDINKYRQVIAANVTGVIHFLYKKFPGLITIEYLDQSEVESHRKDFEGIIDNPVERALYRKFQTEGLTPPVSELWSIKNKNEQIGIIYFADPKDGKKGAHGIRCPKCGEKAYPRSEDDGYKKDKNNKIFQCKQCGFHNLNNSMGLLGLDSNDKVAAYNIAKRGLEI

SEQ ID NO: 242 - protein, 1271 aa, unknown
  metagenome-derived sequence
  MISC_FEATURE (1)..(1271): Unk66 Cms1
MLESFKDLYEVKKTESIWLTQPNKKWEKISHLELNELVKTSLESIKSDIDKDDNSIIKNEKNLIENSSQFVNELNVQFWTWKNIYKSYDLISVNKDYYSILAKKAKFDAFWKEGRTKYPKANQITLSSLQKWGSKEKIIEYWKEIIESSYYLISIFTQKLDQYENAVSNPEKLSHTKPDFTDFSKIFLQLLKVSEDYLKPLFDKSINFKTWKKLESEEDIKEINLFISEENNKNIYSLLKLWSDISEYFEENWAQVPYKKVSLNYYTAVQKPNNFEWEIKKAIEDLWIVEFLNKSDSQIINYLHQGSKQKKKLLLTSKHPYPIELLQLFKVKPIPFSVKYNLAKFMEKNYKNEINLSYEDILNKFNLLWSAIDIANDFKNSNNQNNFSLDEYPVKLAFDYAWENTASSLKSTIPFPKEVCKQFLKDNFDVDIDNADFKLYANLLFIADNLATIEYNNPNNEVELINEIKQAFECISFPFDKEVYKWHKEAILELLDKEKSQSDYSTILKAKQELWLLSWWLKNKIKKYSDLTQSLIDKKNSHFWIASFVGKTLATISDGLKEENELNKISDYWVIIEDSNQDKYLLTLELNGKDISDSISNSLWNWEYKTYEVNSFTSKALNKFIKNPLSEDAKKFHGKYKDEYSFWYENKDWDFTYKITKVSKYDEQGKWTWYQESFLSHIKKCLIDSEISSEQNWEAFGWNFAGCNTYEEIEKEIDSKWYQLTENSILKETLGKLLKDEGCSLFPIINQDISSQKQENKNIFTLDLEKVFEWKECKIHPEFSIFYSKPIEEHKKENKSWIINRFGKLQLLANLGIEFIPSNSSFKTKKEQNSIAIDQKKQNQLVQEFNQEKVNTYFEGLDNYYIFGIDSWIKQLATLCVTDKDWVIQSFDIYTKFFDSKEKIWKYTKTSTEGVLDLTNLKIESDKNWNTYIVDISLFDAKDEDWNPTGTNKQNIQLKQLAYISKLQYQMSANEEWVLTFLGKYKNKEESEQNMKGLITPYKEWKNFADLPMDIFQEMFENYYSLKTDQNLSESEKKNLMKITTELDASESLKKWVVANMIGVIYYLMKKYEYKVKISLEDLSNAWFFSKDGLSWDVVLNTKNDETMDLKKQDNLALAWVWTYHFFEMQLLKKLFKISTEEWVLHLVPSFWSVKNYIEIMKIKGKYVYKQFGIVYFVDPSNTSSKCPVCWKWWKKYISSVDNVVTCKNCWFDTSSDNSILINNYEKQWKKLHFIKNWDDNGAYNIWEKISELPKKSDVKNTSISWNISFS

SEQ ID NO: 243 - protein, 1209 aa, unknown
  metagenome-derived sequence
  MISC_FEATURE (1)..(1209): Unk67 Cms1
MLESFKDLYEVKKTVKFELKPSKVLPKIKIKNIDENFINEFFSNYNKLLEIYEKVFFNNSEINGKIKFSFSFLKTNLKKEYYELWIDKIKKSASVNKIKLEKIDNYEKLNSSFLSTLKKQNEYVNSFKEKIESPYENKSSKSELVLLIYNLKKSNNFPFIENAFNNVTAENIMVDDEIKKWNMLAKTISNQLVTIEEELLPQNSMWLVIESATFNYFTINKTPIDYDIAIKNKKNKYNEIIWKQNKLKNTYKKQSINEFIKYIIEDGFSKFENQIYEQNGKYIDTGSKWSSFNELTIENAYTLMKKYKSDQKTAFYEIIKKEKYNFLKSQNNKITITYNKDSFNDKKEEITVKLFNDISKWNFDKIAMLTKKIETLAELKNYLEKKEFNKFQEKINTLQEIININFNNDNEEEVENLVKSLNADSVLLKKESWTYFDKESNNFAFTKYKEFCEVYQEVAMTLWKAKADIKSLEKEKIQSLFLKSWALIVENKEKNQFHLLTIPKKNISKASNIILALKNWENNNNILYLFESLTLSALKKLCFWKEFSENSGDYTEKSSPFSKSIEENITNSDFDNINFYIEKQKKDGNNYSVLKQYYDFYINKEENKELDEELLIKFYKSVLQLPSTLEQIIIKNFPDYESFISKEFNNLEEFEEGIKSTFYIKQPLKIEEHKLNKLIKEYNWNLYKITNYNLIKNDLDEIKELKEKEKFNSNHIKNHSKLWWNFWEKENIDNKYPISINPEIAISFVKKDDNFYEENHNKLFKNSSFQDSFLLTTSMTEFATNKSIYLSYKELSELKNFYNSYNYNFSENFKWEYIYWIDKWDNELASLWLFSNINKNIEAVKIETYKLKNENLLFKEWTSNTPAYKNISNYIEKDELFEIKEVSCIDLTLAKLIKWKIVLNWDISTYINLKITAAKSSLYNIFSKWNYKEWDIIEKWKFKDKNTGEEWYDWTLKFNQKEIYKNNSEIEKIISIDKVKNILEEYIEEIKQNIYNEDISIEKINHLSDSICSNMIGIINFLQEKYSWYMFLENKKIIDSNKNFLKDWYQLGTSFEQKLLQKFSNLNLVPSNYKLFLSISDEDKEIKQLWIISYIDENSTSSACPVCNPKLYNVNSDDINKLYWHWKWEEKEKSMHHINDKNDENHQEWKWESWKLESWDLCDFHIWYNEKYPDFSFIKSWDDLATYNIAKKALEYLEYLKSLNNDETK

SEQ ID NO: 244 - protein, 1268 aa, unknown
  metagenome-derived sequence
  MISC_FEATURE (1)..(1268): Unk68 Cms1
MINLESFKNLYEVKKTVSFWLNQPSKKSDINKTHWLLKDLVEISFESEKKLINNENNHVLIDTEKVLIEKLQQYVNWLEIQLKNWKWTYQSYDLIAINKDYYKILASKAKFDAMWEITKFDKKSNKYIKVKQPQASQISLSSLKIWNSSDSIIQYWWEIIEKTDYLLNIFKPKLEQYEKAINDANSAHIKPDSIDFSKTFLQLLKLTKEFLQPLLDSSIIFELSKKKVSQEIEKISEFAWEKNNTKIYNVLKNWEELSQYFEANWSQVPYWSVSLNYHTAVQKPNNFEQEIKKAIEDLWIVEFLNKSEQEITSYLHQDSKQKIQLLLTSKHPYPIELLQLFKVKPIPFSVKYNLAKFIEKNYKNEISLSYEEILDKLNLLWSAIDIANDFKNSNNQNNFSLDEYPVKLAFDYAWENTASSLKSTIPFPKEVCKQFLKDNFDVDVDNADFKLYANLLFIADNLATIEYNNPNNEAELINEIKQAFDSIDFSFDKESYWWYKNDVLVLLNKAKSQSDYSTILKAKQELWLLSWWLKNKIKKYSDLTQSLIDKKDSHFWIASFVGKTLAKISDRLKEENELNKISHYGVILEDKNQDKYLLISQLDGKDTSEKISQKLGNGDIKVYQVNSFTSKALNKFIKNSWSEDAKKFHWDFSYKHKEVSIYDEQGKWIWYQEEFLNHIKKCLIDSDISSEQNWKAFGWNFSCCNTYEEIEKEIDSKWYQLTENSILKETLGKLVKDEGCLLVPIINQDISSQKQENKNIFTLDFEKVFEWSEYSIHPEFSIFYSKPMEEHKKENSSWIINRFGSVQLLANLGIEFLPSNSSFKTKKEQNSVAIDQKKENKLVREFNQEKVNTYFEGLDNYYIFGIDSWIKQLATLCVTDKGWVIQDFDIYTKHFNSGSKSWEYKFHSKDWILDLTNLKIESDSSWNKYIVDISLFQAKDEDWNPTGTNKQNIQLKQLAYISKLQYQMSANEEWVLTFLGKYKNKEEKEQNMKELITPYKEWKNFADLPMDIFQEMFENYYSLKTDQNLSESEKKNLMKITTELDASESLKKWVVANMIGVIYCLMKKYEYKVKISLEDLSNAWFFSKDWLSWGVVLNTKNDETMDLKKQDNLALAWVWTYHFFEMQLLKKLFKISTEEWILHLVPSFGSVKNYTEIFKDKGKYVYKQFGVIYFVDPSNTSSKCPVCWKWWKKYISSIDNVVTCKNCWFDTSSDNSILIKNNKKQWKKLHFIKNGDDNGAYNIWEKISELPKKSDVKNTSISWNISFS

SEQ ID NO: 245 - protein, 1188 aa, unknown
  metagenome-derived sequence
  MISC_FEATURE (1)..(1188): Unk69 Cms1
MASICTGEREVINMEQYKITKAIRFKLEPKHISKIKSDVGAIELKNKFNLASFISSLGSFISQFNEYIFYESRNNEFIIKGNLTVKNIWLKQYAKQEIVGLKLKRGQTIGDIKGLSDKIRKARDEVNDIYLKLCDETSKLNERANRAKKGLLIKRLNARNSLPLLLSLIENTTDKNETGNLSIQLKQLGAKLQSQLDSGVNMYLPAQSNGLPIAKASFNYYTINKKPIDYDYGQKKQEQIDKLEINLDSNFDSLIPQHINISNNLKQAIKSDISDIAKKGKDNTLLLGDAPFVNHDYVSIRQILKNIKAEQKKIFSEFIPRDDSTFKNLKTNSRLYLFNDISGEEFNDYKHKTRVIEEKAEKKNQCNNDELKRELNSELQNLKKERGSLINAADRNTKGKFKTYKAFANIYGKVARDHGRILSTLKGIEKEQVESQLLKYWAVVIEENGQHSLALIPKKNAEEFKKWLENNASTSSVSPIKTYWFESLTLRSLRKLCFGYIENQTHSNTFYPELKKSPELENYKDDRGDFIRGEFFFEGDEQRLIKFYKDVLGSQHAQKVLSFPKQQVKDDIIDKQFNTLDEFQIALEKVCYRRFVLCSSDIKLKLKEYEAEIFGITSLDLRNATKTNIKNHTLIWRMFWNTKNESNNFDIRLNPEITLTYRSPNSGRIEKYGKDSELYDERKNNRYLHPQYTLVTTISEHSNAPTKIMSFMTDDEFKTSVDAFNQKLKKEDVKFALGIDNGEAELSTLGIYLPVFNKDSNSEIWKLFKNVSEYGFKFLTIRNLSYSEIDANERKRKIIQNPSYFLNKNLYMGIFGRTEQDYDQMLEKQFEEKSLLSLDLTTAKVINGHIITNGDVPTFFNLWMRHAQRNVWDMNDHSKYKTAKKITIKNNDELTEAEKAKFAEYISDGKKYEPLTAKEKSKYLKWIFENRNLLQFTDEEKKKFDNCQRRKDNFSKNILFAVCSIGTDIYSVTDVFDVRHIFKKRKNFDVLKSEAEIIKEIESYNTNKSIRKISNEELDLKINHLKQSVVANAVGVIHFLYNYYKEKTGGEGLIVKEGFDTKTVADGLEKFSGNIYRILERKLYQKFQNYGLVPPIKSLMAVRGGGIKDNGLSKTIRLGNVCFVSQSKTSGICPLCNSKKLDHNTTCPDCQSDLIEIFHSNNGVAGYTIAKRGFENFNNNSNKGVSEK

SEQ ID NO: 246 - protein, 1129 aa, unknown
  metagenome-derived sequence
  MISC_FEATURE (1)..(1129): Unk70 Cms1
MMEKLTNLYEVIKTIKFELKPSEFTLKSCSFDSSFESDPHVLFEKLKPIHKQQKEILNILSNLPPQKIVIHKNLIKLIDSDYFYSLKSKALSANNTLVVLSKEFQEEFSNYIKEKFDSLHSTNYSLSYLLWADSLEKPSNTDKKPTKSEIAFAVKKYVHAVQKVEEIISNIIYKTWNTDNELKTMLKSYYDNKDLWYIFSIANSYLQSYSPTSWFQVSKFGFNAKAISKKVDVEKMEKEISILETKMLDLEDKKVIATQIFDDYTKKFVQEKIKTDPKLVALSENQTASPNESKQAKEYLKTLKEWDFNYQKILKESSKAKKEQKKYEPKFTWDKEYCELKLAKIDASVIYGSAKWDFFAKQQELYSQQALSHYASLVSNWEKYFVVMIDKDNINELDNLWDNQIKNDDYFEILSYSSLTAKAVEKLIFEKNALNFNRYDKEYKDCKNIREKSTYKEKGSEDSRSITNDQKTKLSKLVSFLNEAITQLNKKVEWWVFNWVPFNISNEFDDFAEFSKYVTKTCYITKWESISKQIIYDLDKKWILDFYQIYNKDFAVDPYFAKTESDKNRIKKDISIMGKQNLFTIYWESLFGDNSSNISLNPESNLYVRPAKVVEEISDHNPNYETSKLSYKENKIIWDFQLVFYPTKELPLDKLQKKILDEVDKSYAIGIDLWENSLATICLIDNEKSVVLDEEGKPIIKDLSMINNKWDFVELDDCYIDWQPYKSKQKLLVWGQGNKPYTLGRYFPEKFQNQVISKMSKETLIEVLKILEDIAPEKLWIVDNHWNKVFDYNYAFEHLKATNKISYHLQAFDHTNEEMEILEKDLLASTKISGWFVWKVVSYITQMSKKYNALIVFENLDQEIGRISWMTLFSEQEYEKVSAKEESMYKGISPYQLIQDKIIQKCNYLLSKQDNTKWIQISPSLKSQEDIKQLTLLKDKNCAWWKVVFVNEENSSKECPECWFIPWKYSSNINIQENWIEIMANKKDKKLLLFENNPLLNESRIAYQSIPDTNELKKKSLLIETKVGKTILTETDMKIVWDPMICVNCGYDTSKEEWVKKYNLKSCDEIAAYIIAKKWLEFVENKWYENQSIDKPSQTNTFEENKKSKNSDNENSSYTMSGNINFSHS

SEQ ID NO: 247 - protein, 1135 aa, unknown
  metagenome-derived sequence
  MISC_FEATURE (1)..(1135): Unk71 Cms1
MLSKKNKKWIKQPQANQISLSSLHDKKDLIINYWENNISESDFLINIFEPNLKKYLDALANPDKYSHTKPDLIDFSKTFLQLLNVNKEYLQPLFDKSIIFETGKKGESKYINEINEFAWNENNLKIKELLDLWEKISQYFESNWLQVPYWSVSLNYYTAVQKPNNFDDEIKKWIKDLWIIEFLSKEESEIQVYLNQESKEKIKLLKDSKEPYSIELIQLFKPKAIPFSVKYNLAKYIEKNYKKELGLKYEDILYKFDLLWSSYDIWKDYSECTEKNTFSLMKYPIKLAFDYSWENLASSLKKDIDFPKEICKNFLKDNFDVDINNSSFKLYADLLFIAENLATIEYNNPSNEKEIIDNIINTFQIINFEINGYKKKDYENHKTAILSLLEQGKNESDFKSNVFIEAKQKLWLLSWWQKNLIAKYKELTEKLVDKKDIHIWIASFIWSNLANISDGLKEEHELNKITDYWIIVEDNNNDKYLLLLSLAWKDNSEQLKSKLWDGEIKVYEINSFTSKALNKFIKNPWWEDAKKFHWNFNYKYSDISTYSHEWKWIGYKPDFIKHIKDSLCNSEIAKEQKRVEFGWDFDKCNTYEEIIKEIDSKWYNLINNTISKKNLEYLIENDNCLLLPLINQDISSKKTINKNAFTIDFESAIDWKSWYSIHPEFSVFYSTPMQEYSKENKFWIVNRFGSLELLANIGIEYVPSNKNYTTKKEQNKISLDKDKQNNLIKEFNEEKVDNYFDSLDNFYVFGIDSWIKQLATLCVMDKAWVIQDFDIYTKHFNNTQKKWEYKKNSTEWILNLTNLKVESDQNWTPFLVDISLFESKNENWKSFGTNKQNEKLKQLAYVSKLQYQMSFNNESVLNFIKKHTTQEAKAENIWELITPYKEWKQFADLPIDTFEEMFENFHQLKTNENLSELEKQNLMKLTTELDASEELKSGVVANMIGVICYLMKKYHYKVKIVLENLSNAWYFSEDWLTWDALLNSKNDWITDFKKQENLALAWVWTYHFFETQLLKKIFKISIEEKILHLVPSFWSVKNYTYLIKNNKSQYVFRQFGIVYFVSPKNTSFKCPICLKSGSEYITKNDNIITCKSCGFVSWKDNDEILKKYTKTHLNIHFIKNWDDNGAYHIWKKLLK

SEQ ID NO: 248 - protein, 999 aa, unknown
  metagenome-derived sequence
  MISC_FEATURE (1)..(999): Unk72 Cms1
  MISC_FEATURE (741)..(741): Xaa=Asp or Asn
MVPQYEFTKTIRFTLNGENTTFLLDKDINWQKTLNFNDFQISFNDLLNQFKKTVFYINNNGKLVVKNSLEIKKSWLRQYARDEFYKFNENQRKYNKFPAKLFQPIFNDWFKRNKSLLRQFEKINQMPQESQIKRSEILTLLQEIKIADNFLFIKNFVQPGIVNDKKSDYNLEDLKEKVNRFEELLNKAIFAMAPDLSQGAEVCRASLSYYTVNKISKRDFDKELEYKKQELKKPYNKELNQRLLKMVGFLDYLKSEYQSDIQNISIQNLYEALKQFKSQRKSEFMQAVQQGKQVKELIKDFPLFNAQKDSMQKFIYASKDKRGIYFQNQWGFPNYVNFCNNVFKPVAIKIGNLKAQIRAIEQEKIEARLLQYWAHILKKDNKYYLLLIPKEKMQEVKKFLNSLNFKKEREYTLYSFNSLTLRALKKLIRKNLGKEQIRLQNDNTAIALYKEVFQDKHPKLQNLDFSGFEKDIKKIIQENYNSEEDFRLELERVAYCCFEKKMNQKDIDLMRNKFSALLLEISAYDFERNIMGEMKEHSKIWQKFWTVENKNKNFPVRLNPEIRIFYRPQRQQGDPKKQKNRFAKDHFGVAFTITQNAAQKKLDLAFTKEKEISEAVKKFNKEVIGEFIKERDDNLYYYGIDRGQQELATLCVMRFSKEQGEIKLANGEVKKFDIPIPTPIKLYRIKENHLNGTKEIITDQNGKKKIVRILENPSYFIDEEEKFEEIKSTCFDLTTAKLIKXKIVLNGDVRTYIELKKTNGKRQLFEKLSKIDDNAKIEFCEDENGRRFQIKSKSTERNKYQYIVFYSPQDEKIMSREAMQRDLQEYLDYLRTNNLAKEDISIEKINHLRDAITANMVGIIAFLFKQYPGIINLENLTETHFEKNNENIERRLEWSLYKKFQKFRLVLPKLRQTVILRKEDNQLNQIGIIHFVSPQNTSSSCPVCGNVVPMGKREKDKFKYHIFICDKCGFNTQNPKSPFDFIKNSDEVAAYNIAKIQLK

SEQ ID NO: 249 - protein, 1125 aa, unknown
  metagenome-derived sequence
  MISC_FEATURE (1)..(1125): Unk73 Cms1
MNDDFKNLYEVQKTITFELKSKYIDYFYKNGQCVENKNCFINFEKTSKFMEKNYFSTSQNKGNFDCVLKFLETTDKIVRFADNFATNFSNGNILARGFEVKKKLLEKYDRISFFELKKRKQITVKRKNVNTGKTYDHFLYFSDRMNLENLFEMTNDQHGINFCQYLEKILNRIKLYRAKMENNLTVNNDNEFTFNKNKVVFCSDAKIYFEEFKTLLDIFSLIERDKKVGIYTIDNEVNETNKIIEVFEFINNKYSITLKSNLGSIIEVVNKEAKKPIILTSLNPRVVNKDSKKTESEFQNIQEFEKEIEIEEMEMDAINIKKFEYVELLEKKLKNSLDELKVLKTDIQSLINKKRRNEKLLSNEIALWKEFQFAKTILKYIKLNGVVISNKKNGRGEYQDVFNYRKSGERLNNPKNLLGIGQHPLFHLFKEEYDNYKNLCGEKFRKAKSLGDKKSLYNAVSREVLRQKEMQYLSFLAKDSYFYYLVLIDKDFNKDRKVIDQIGGCTGNWQMLDYYQLTFKALEKLALLGESTFDINNQDITKEVKLIWQNYKEKKFKEYRLCREEKQGLNRFEIDNKKESLQKNELNKLIDFIKKVINKLPDSKKYNFQFKSTEQYKNLDEFKKEIDEQGYFSEWISIDKEKLLQLEKETQKEVLIFKLHNKDFRKVAIDEKRKQNLFTEYWLDAMRLEKEVRITPEIDIFKKNKEEGNVPEKRVLETSQKEVISSARIYQNKLYGAFRLKFYPNRSCSFEKVNEKIKFKDNVCFLGMDRGEKSLISWCLIDNTGKLIKNGDWTKFDDEKNSDKKANYAEKLKIYKEIKECILQDYERIAECIGSEEKQKLIDEVKKKEKELEAKSLLATETIKQGYCGHLIKEINKVLLDYPNTYIVLEDLDIQGKSESRESDITNKMDNLAKTMGATIYQTIENALVNKFKYYSVKTDLEKYDGQQLVPNIVKVEDLRICDKENREYGKQKFIKSKDKIGNILFIDEYLTSNECPNCGFNHEKIKNLNFNFQESDQNYILENNGEKYLFSKDWFKEERVKNVLYDKKIKQIFFPRAVKNPFIKSSKSKKDFFYCSKCQFSSENNLVNLGLINGNYQIKTGDDLAAYIIAKRGLTLILNKKKEI

SEQ ID NO: 250 - protein, 1098 aa, unknown
  metagenome-derived sequence
  MISC_FEATURE (1)..(1098): Unk74 Cms1
MEKFKITKTIRFKAIPQKAERLQAQAEALMDNPKADITVLVIKGFDLINLFEELVYTNDKKEYLRKNITIHFRWLRQYVKNEWYDWKQGKIEIENDNNKAKQKQPQKSNSPFASLLAIRDNFDDAKEKEQTDHTNKTAKNSEDKKLPLGSVPFLKNELQNISSSWRELLDELRKAFERPEENRMRRADIAKFLGGLSTRQMLPALIEFINDLNDKKSEEQINALKKLVQEFKELLETCQNAYLSAQSSGINIARASFNYYTLNKKEKNYTEERQKILNSLSRSFFEKGRVPQIIKDLSIDETLSIGNLYEFLKKYKAEQKQQFQEAVSQGLKFNELKEKFPLFDTIEPIYKDFVAKTNAITQKSTALQNSSQTKDLKDEINKLKRERGQMFQKGKFRKYTELCDVYKKVAQNKGKLKAALIGIEKEKLDSQKLQYWALIGRQNNQYKLYLIPKEKVQEAYAEISRQGRIENEVSTPLYYFESFTFRALRKLCFGVNGNTFIPEIKKAFPEFNTPDFGEHTFRTGNIEQDEQNLIQFYQKVLDTDFVLRNLRLPHSQLQEVIDTKYNSLQEFKIAIEKVCYAKQTVLNSRVLRLLETDFKAQIVELSSLDLNKENPTHLKAHTLLWNSFWSKENEANHFTTRINPEISIYWREAKASRIEKYGKGTPLYDERKKNRYLHPQFTVAFTFNENALSNELNFAFEGFEKKKEALNNFNQQINQEFKKGLENQILGAFGIDTGEAELATIGLTDNGKPFPTKLIRLKTEKLNFEKQGFFKDGTPREKPYRAIDNMSYFLNQELYEKTFRDYLFQETYTEIFEEFETTTIDLTCAKVICGHIVLNGDLHMRTKLNLLNAKRQIRQAQILNPSLEIKFEEDKILMPETDEDKKAITSWKAIYHTNEELEQIQPIKTVNEMLLSYLKEIKVDESIEIESINRYRKVVAGNMVGVIAHLYNKYPILIAIENLAQGTIEKHRLRYQGVMDRPLETALYRKFQSKGLTPPISDVVAIREALTEKKNNKKSQLGVLQFVDEQLTSKTCPNCGKNAYEGSRKELYLKEKKQGIFSCTCGYHNINNPMGLNLHSNDAVAAFNIAKRGIKNIK

SEQ ID NO: 251 - protein, 1175 aa, unknown
  metagenome-derived sequence
  MISC_FEATURE (1)..(1175): Unk75 Cms1
MQKYEVKKTVKFELLPKENTSKPEINNQDYEKNLNEFIKSYEEALHKLQKILFKDDTLNENLKIKLSFLANYTKYEFYKYDIVLLKKWTNNKVSLSSEKLKYLYNLLKSKIEENLNLLKKLKELLGLPLENQSSKSELNFYFSKLTTSDNFEFFHQLAKNLSSEKPHFANEIEKIISKFENIENNNLMEKLSLVLKSTWTFWVEILSASLNYYTVNKKPKDYDKKILEKKEEFNKLIGNFKNKNGKNIFDNNIAQNSWFNSFLEDFDDSYFWGIKDYQWNTKKEKKYYYLSIQNAYDLMKQYKAEQKQAFIQFLAQWKNFEDLQNEFEYHITKEKTKNVKLKLFYGIKEEDFNTMKELTKQIAALVKFKNQLKQKLDDEKKQNLEAEIDSYNKTYGTNYDLSDENLLETIWKDLEKIAKESGKFFQEKLSKYKNFAEEYKKVAQTLWSIKANIVSLEKEKIDAKKLTHWALILEKDNPLQETCSTDSKYKDCKLRYLLFIPKEKISWASKFMDKLNPNPNWKWTLYKFESLTLKALKKLCFGKENNTFSWWIYEEAKNYPELLNEKWKLKELYEIKSDEELIKFYQKVLDLESTKSQIKLEYFDENEFNEEVVNADIKTLKELEEKLKKTAYIKKPIKITENVKNNLIKYNNWQFFKVTSYDLQKYDPEFIEQLEYKDHFDSNHPESFTQLWWDFWTEENEKNWYPVSINPELKVSFIPKQNWFDKSKYGSDSFIVAFNMSINALAWELNLSFKDKDELKNFFENFNQEINTEFKDKPYFYWFDKWENEIITMGLFKLDENQNEQKWVKITVYELKPEYFEKEIDWKVVYKNLSYFQYDGYPQFYKEKEVSCLNLSMAKLINWKIYLNGDMATFLKLKKIAGKSKIFEIVANKQAKSKQIIEKDWKLYIDWNEGKSESLYLFDEKLWNLENKEKIKQELQQYLDKIYNDLSKEEVSIEEVNNLSWAIASNMVWIVNHLFKKYPGYFVFEDKTIEDNKNRFEKYNITIWTIFESKLLQKFTYNGTVPPNYKLFFTLKDEENLNQIWNFIYIPETNTSNACPVCSIWNFLKKTSNGKIEVDNEKIYKLFGHWYWPEFENSMHHLSNEEYEKLKNEWILKGDDLKKNKYQPWEINWKECDYHMGKNNYWFNYLHSWDDLATYNIASFGFDYLKNILKI

SEQ ID NO: 252 - protein, 1194 aa, unknown
  metagenome-derived sequence
  MISC_FEATURE (1)..(1194): Unk76 Cms1; Xaa=Gly
MESFKNIYEVRKSIRFELKPYNVTREILKGDNDYXNLDSKIKHIKKXEFEENFNWNRFCLNGYSNFLEKSKSFLTFLEEVNLEIKKENWIKXKKDIYFDFKRLKXVFKNIPSLKKIEKFDNNFKDKLYEIEKEYKILFHIFQKLENKEKXEANEKKSEISKYLRKISYLNRNFLTIFKFFDEYKTDKYLFDNYKKLLDETFEKINNSIIASNENEKTGSCFXKFTFNKYSLFRRETENLKDKYYKNKKLLEENVKNIVETKKIKDDREKIIEIKLETILDLKLEKENEKIQERLEKFNFERNLDEVISELDYINXNILNNYIQNFIKDYKENKQTLIFKNESSNKYNKXKIILNNNEYNISALRXQTLEXXEYLTLLKKDYKDLNKDEKEEKRLVDKFLNIILKNKNINKDFDTIKNFRDKLAKYRXKLRQNFSASEREFINEAMIKYYAKILEKDXNYFLALTDKNNILDKNINNIKIDKNIKXNIFSNTFNIYNYSHLHFXALEKLCLMXDXDLIKNDXLIKQWNKYKNQKNNINXRCAIHQRYFDKKCENCKNDKEKKEKEFFSSFQSHIIKSLYKLKENNXEDWTQYITEIEKLETIEEIVKFINSNFYKLEKKEIKTEEIFELAEENEVELFQIYSKDFNIFNEKFLSXEENLRILKSXEXYREDKKEHXEETKLISNTKRKKDKKKNLFTIYFEEVFKNRDTFLXQEXXVFFRNANLESDKKRFRNNKFFVSFDIKFNKXTQNDNIKLCEKKEKILEEHIKNINYITISKLKNIKDENKIFIXLDRXEKEHISYGIYDXKLKFQXKIXHTNYVKKIXKEQEKFQILEQKDYENITLKIGNKIIKIEKPIYKQLTTTHKYFDENXKEEINLLELNXLQEYHILYIFKQXENXEYFVDLENXXKFILNSKKYXFTILDRNXEEIKIIDXNDXKEIIDYYLLFESEKFKRILEINDEIKYSENMFNLKKXYISIIKDFFDKIIFDYKKEXKEVIFIFENQTSNKKDISNKYLXSTILSDIEENIITKFNYLINKESNDKFQLTPKIKKEDILFKNNNIYEMFXNCIFINQDNTSTXCPNCKKIFLNKXKKXKIEEIPXNTLFXHXTGNNEXNMKHLTYEEYDNLYEKDEKFKKNHTNKNXKKIQNKYLALNNCKFYLQNQNFSEFNFIKSXDNLATYNIAKKXLEYINSLN

SEQ ID NO: 253 - protein, 1149 aa, unknown
  metagenome-derived sequence
  MISC_FEATURE (1)..(1149): Unk77 Cms1; Xaa=Gly
MQKYEVKKTVRFKLIPIIKNSENLKVSLEKQINLEKFIKNLENYLNKFKNTFFYDKEKHIFKNKIEIKYKWLQEFTRNNFYEFLNKNNKNKKYKLSEINYLPVIFKDRFQELENIINNLKIIENLPEENQEKRSKIAYFIRQLAKKDNFDFITSFIKYISNSNNPYLDKDLKNLQQLADFLKNDLLLLINSYLPSQSAXLEVVKASFNYYTIDKYSNINFEDKLNEKKAEQRQKIKEIRDNDRSFSKKFYXQSIKLDEKFFNKIXIKENLYEKTLEEAYDFIKNFKANAKSHLISDLGKEEFTTYTKSFNTIKKEERKDYIQDAFDLTYENFQKVHPLFDMTEEDFNELMKLSKEVRELANKKNKILQNYXDIKSKELEEKIQNKKLKNQEITEEENKFLEINELLKIKKEERXKFFNKPXQKVYTKNYYLLNELFKDIAIKRXFLKAEIAGIEEEQNQARLLKYWSLITEKDXEKYLILIPKENRKEVKNKIEELNNDXDIKIYYFKSLTLNALKKLCFKKIGNTFIKPVFQELLFKDDNKPYFKTNKRXKKQLKRYDELNEKELIIFYQDVLKSEAANRQLDLVDFXELNKIFEKDYRNIEEFRIDLEKVCYTKLVKXIDDYNYNKLINENNIIEFKITSQDLKILEEKDEKIFPKHKNKEHTQKWLNFWSKENPENYYPTRLNPEIKILYRDKLLERENXKKETRFNKEQFTLSTTLGLNIPSKRLEFRFDKTNTIKEKVEFFNEKFNKEFKXEWNYXIDRXINELATLSIIKWKDETYTYNXKTIQKPEFARIKVYKLKDENVTXEVEKYDXTKKEVKVIDNISYFTGQENLFESFETXVIDLTQAKLINXKIILNXDKNTYMKLKLLSAKRRIFELFANXKITELKFERXKNILFFLDKDNYYYPIYWFTEEQKQNKSLIDEIEKKLNNYFKYIQKNNLFEDNETIEKINHLRDAITANIVXIINFLQKQFPXKIFLENLDKTLLQREKFSYKKXNDGELTQIEEKMIDXHFQQSNTDISRRLEWXFYRKFQEDXLVPSNLKQTIFLKDDFXINQFGIINYVEVKGTSSICPYCEKITENKXXLKNHINKNTDENHKLKPNLSKIEAKNCIYKELYNKNLQLNYDSIAAYNIAKRXYEYFNSLK

SEQ ID NO: 254 - protein, 1215 aa, unknown
  metagenome-derived sequence
  MISC_FEATURE (1)..(1215): Unk78 Cms1
MNSKEQKQLASTSDYSYNKAIRFRLEPVAGPLPVIEKGHYSLNDLTEKAGVFADKFEQFIYKTSVNGAFIENNRGEKFPDPRVSIKKQWLKLYFKNDFYASGRKKQKEFSLDKFKYIEEPLKEFITEWRNTLSSLRMIAVQPDHSKQRRSEIAECLSALASKFQFQLLRDFCEYANHKDEQKSLNDLKNLSEEVDQILTSLVNDYLPAQTAGLVVAQGSMNYYTVNKKPKNYKQEIEKLEKELESLDAEYTKMKLYKAEQKSRLYELINSNADIDTIKRECPLFADQDDHCLNAVIDLTKKIDELTRIKDENNKLSDKQKKELKDLKIERGYYFIKKTRGKKHSYYFKEYEKYCNKYKNIALERGRILARIKGIRCEQIESQNLKYWTLIFENEGKPYLWAVPKEKMQEFRKEFNHLDKGNAVLYIPHSLTMRALHKLCFAEESSFAEEMRKKDYGLYKMLSAAKKATNDEKSRNFCYGSTKDDLSLAFFKELMKSKFAHEILDLDFFELDELQTAENLNEFEELLEKACYYMEPLYLTKECAEELIEAYDITVFRITSYDLEEHYRNTHQTPESEPKRHTREIWEKFWKFKGKEGSVRLNPEVKIRFREKDENVVRYLESKGFDLKKIHNRYAEDQYILTLTFTLNAGKRYPQLAFAKTEDICREIDNFNQKFNEQHWDNLYKYGIDRGEIELATLCIAKFRSDDTYKDKNGKVHMKPTFPNGENDIKVYKLKKEWYGKKVKSNLETRPFDERKEKRVIANISYFIDRTEDPDWFEKYTCTTIDLTTAKVIKDKIVLNGDVLTYLKMKKEAAKRVLFELVAEGKLNKDCRQLVWEKHFSSTALVFPHINEKCEIAYNAAADVVYFFEDETGKDFEGMLIKDDIAYTKENVLNNLQSYLDTLIEEHSKDSSDINKHVPTVSKLNHLRDALVANMVGVIMFLQKEYPGIIILEDIEKNLMQKHFEDIYNNISRRLEWALIRKLQTLSLIPPHIKDIIEIRERARNKNKEESSFQLGALVFADKKNTSAKCPYCDKKWKWGGKEKEYKFTQHRYICGEKHSCGFDTYSIGKDFEFLKDIDDPDKVAAFNVIRKVLNYKTISKFEGKISEKADKNGFGHKKESSQHKKSGSASISYRKPKVKKEEKRETVKIIETLSKGNAGSVIKALKKLKGMNLIQSDIELLSAVLKKRSDSKQSFNPQVKEYKKLAEELKKQAGF

SEQ ID NO: 255 - DNA, 3096 bp, unknown
  metagenome-derived sequence
  misc_feature (1)..(3096): Unk46 native coding sequence; TGA encodes glycine
atgaatcatcccatacaaaaaaactttaacctttttgaggtaaaaaagaacattagatttgtattagaacctctttttgaaccatcaacatcgtttgaagaaatatcaaatntaaaaactgacataaaaagctttttacataaatatgatcttgttacaaaaattatgtactgaattcttttaaatcaaagaagaatgaaattaaatgataaattaaaaattaaattttgttttttaaaaactcacacaaaagatgcatattttaaatatggaattgaaaaattaaaaaacaagcataaaaatcaaattgaaatgagcagaagagaacttgattatttaattgaagtatttcaaaatttctttcaagataattttacctatagtgaaaatttaaaacaacttctctcacaaacatctctccaaaatcctgacataaaatattattttcataaaattgcaagaaaagcaaattttgattttttttgtgatgtttctcatagtattaacactgaaattccaagtacttatggcaaaatcactgcgattaaagaaattataaaagatttagagatgctaaaatataaaattcaaaataatttacatcaagaacaatcattatgaaaaaccatagaaatatcaaatttaaattattttttagcaaataaaaaatctaaaaattataacgaacttattctcaataaagaaaattctctataccatcatatttttgcatttccaaagtttcatgcagcaaaagaagaaaatggattaaaagatttcgaaaatacctattcactttcgtattctcattcaagacttacagaaacatatgaactactcaaagaatataaaagtagccaaaaagaatgatttttacaatttattcaacaatgacattgatttgaagatttacaaaatcatgtaagtttcacatttaaaagtgatcattttgaaccaaatgaattctctttgactctctacctttttgatgatatttcaagagaaaactttgaaatgataaaaacattatctgataaaattaattttttaatagatattaaaaataattctgaaaagttattatcttgccaacaagaatacaaagatatgtttcaggaagaatgttttatttgagaaaatccttatgaaacaagaaaagnactcacaaaaaaaatcatacaattaaaaaaagaaagaggaactttttttaataccgaaaatcaaagttntatgtttaaaaaatatgcntatttttgtgcagaatataaaaaaattactttagaaattggaaaaataaaagcacaaattaaaaatttaaaagacgaacaaactcaagttgaaagaacaaacagttgggcgcttattttagaaaaagatactcaaaaatttcttcttactattccaagagaaaaagcaaataattcttattttgaaaaagagagtaatattttacaagcaagaaattttattcaatgactttcacatcaaaacaatgattacaaattatctcattttgaatcattaagtttaaaaacattagataaactctgttttgccaaagaaagtagttattttagaaataaaattgcaaaagaattatatcaagtaaattctgattttgtagaaaaaaaagaatttatcaaatttggaaaaacagtcgaaacctataatattaaaatgaaatatgaacttccaaaaacaatttcatgagaaacatgtaaaaaaactcttttaaatttttaccaatctgtaataaaattaaatagtttaaaagaacaaattatgattgaaaatacgcaacattttgagcaatttataaataaatcttttgaaaacctcattgattttgaaaaagaattgaaacaaatatgttatataaaacaaagtatttttatatcagaagcgtctaaagaatcactcatacaaaattattatggaaatctttataaaattaccagttacgatttagaaaaatctctcaaaagaaaaaatttaaaaactcatacaaaaatttggctagaattttggagtgaaaaaaatacttgagagaaatttccaataagaataaacccagaaataaaaataaattttataaaaaaagatgattctctttgagaaaattctctcaataaaaaaacaaatagaaaattaaatgatagatatttactcactacaaatatcacacaacatgcttgtaaaaactcttgatttataaacgaaaaaacaaaaaaagaaattattcatttttatgaaaactttaatagagactttgaaagtaaaaatcctgaaaatcatcttaatcatagttattttattgatatttgggaaaataattctatcaaactttctctctatgayaataaaaataattctccratagaaataaaaattyataatctaaaagaagaatatttcctacaaacaaatgaaaaatctactcctgcatataaaaatatttcttattttcaatacgactcatttcaaaaattatacgatgtagaatctgtgcaatatgtagatctcagtaccgcaaaactagtaaatgaaaaaatatatttatgaggtgatatttctacttatttaaatttaaaaataaattgtgcaaagaaaaaaatatcacaacttgancattgaaaaatttcagtaagtgaaaccaatccaaatcacattattttaactggatgagctttaccanaaacaaccatttataattttgacgaaagatataaaacaattcaatctaaagaatcaattataaaggagcttgaagantttttagaagcaaaaaatatcgattcatactttccagaaaatatttcaatagaaaatataaataatctcaaaaatgccctttctggaaatattatttgaattatattttttctccaaagaacatatcctggaaaaataattattagaaattttattaccaaagaaagtatgtcttgtcctgatggtctggataaacaaattgaagaaaaaattctacaaaaactttcatctctcagtcttataccatcaaattataaacatattttagatctcaaaaataaaaatgtcctcaacaagctgggaatggttgaatttgtaaattaa

SEQ ID NO: 256 - DNA, 3483 bp, unknown
  metagenome-derived sequence
  misc_feature (1)..(3483): Unk47 native coding sequence
atggaaacatacaaggttactaaaacaatccgcttcaaattagaagcccaaaacgttcctgaaatccaaaaagacattgaaggactgcaatcggaatttaatctggcaaattttgtttcagatttgaaaaattatctcgatcaagttcgtaactatttgtttagtgaaggaaaagaacatgtctttgtaaacaataaaataaccatcaaacgcgaatggttgcagaatcacgcaaaacaagaatgggttgactttttggaaaaaaacaagcgaaacaactctctaaacaatcatactcgcaggatacaaatgtctattggagattttactggtctagcatcaaaaattgagggaacatttgacgaaattaacagcatctgtaaaggactcgccgatgctgctggagcccaagccaacaaaagaacaaaaagggaacgcacaggcttgttgctgaaaagattgcaggcaagaaaagccctgccatctttgttttcacttattgaaaattctgccgacaaaaatgaaactggtaatttaagcctccaactcaaaaacaaatctattcttatagaacaacaattggcagccggagttcaaacttttttgccggctcaatcaggtgggttgccggtagccaaagcaagttttaattactacaccatcaacaaaaaaccggtggattttggtaacgagaaaagcgaactggaaagtcgtttaaaaattagtatagataccattttcaagctgacgcgcgaaaatttttcaaaaaagatagaagaagcaattactgccgacattcagaaagaattaaacaacggaaaaaccttactgcttggcgatgtgcccatgctcggtattgagaactatgtcagtttgcgacaaattctgaaaaacattaaatccaaccaaaaaaaggcattttcggatttgatgcagtctgggaaaaattacaatgaattgaaggcaaccaatttatacctgcttaacactatcgagcaaaggcaatttgacaattataaagtcaagacaaacgaattggaaaaactggcagtaaaaatcaatcaggcaaccaatgataatcaaaagaaggagttgataagcaataagcaaagagttgcaaaacagcgtggaatcataatgagagataattttgcaacttggaaaagtttctcaaatttttatagaacgatttctcaagaacacggcaaaatattagcgctactcaaaggcatagaaaaagagcgaaccgaatcgcaattgctcaaatactgggcactaatacttgaaaacaacggacagcataaactcattttgattccacgggaaaaagcggccagttgtaaacaatggattgcttcgttaaatccgtcaggggacaaactgacaaagttgttttggtttgaaagtcttacatacagaagtttgcaaaaattgtgtttcggctttactgaaaacggaaacaataaatttaacaaaaacattcaaaaccttttaccaaaagataatagtagaaagatcataaacggtgaatttgcctttcagggagatgagcagaaaaaaattaaattttaccaaagtgttttggaatcgaagtatgctcaatccgtgctcaatatcccgattcaacaagttcaggcagacatcatcaatcaaagttttgcttcactggacgattttcaaatcgccctcgaaaaaatctgttatcgcctttttgccgttgtggaagcgaatatcgaagctgaactgttgaaaaatgacaaggcccagatattcaatatcacttcttcagatttaagaaaagaggctaaagataagatcaaatcacatactcaaatttggaaagccttttggactagcgaaaacaaacaaaacaattttgaaacccgcctcaatccagaaataacgatcacttaccgccagcccaagcaaagcaagatagacaaatacggcgaaagatcccaaaaaaacaaccgctatctgcacgctcagtacacattgattacaacgataagcgaacatagcaattcgcccacgaaaatattgtcgtttatgagcgatgatgagttcaaaagttcggttgataccttcaataaaaagttcaaaaaagacgagattaaatttgcttttggcatagacaacggagaagtagaactctctacgcttggcgtatattttccggcatttgacaaaacaacctacaaagaaaaggtagccgaactggaaaaagtgaatgactacggctttgaggtgttgaccattagaaacctaaactacaaagaaactgactataacggcaaagagcgcaaaatcattcaaaacccctcttatttcctgaaaaaagaaaactatttgcgaacattcaacaaatcggaaacagcataccaaaaaatgtttactgaacagtttgagaaaaaaaagttgcttacccttgatttaaccacggcaaaagtgatttgcggacatattgttacaaacggagatgtccccgccttgttcaatttatggctcaaacatgcgcagcgtaatatttttgagatgaacgaccacatccaaaaagaaacggctaaaaagattgttttgaaaaatcaattagacaccgacaatgagaagctaaaatttgcagaatatatttcaaaggaaaaggaattcggaaaactgaatgatgatgaaaaaatgaaatacacgaaatggatttttgaagacagggatcaaaataatttcacggaagtagaaaataaaaagtttaaaagatgtcagaaaatatatggaaattatagtactaaagccaaagcacctgttctttttgcctcctgctttatcgacgaagagctacaaagtgtaacggatatttttgatgttcgccacattttcaaaaaacgtgaagatttttatgccttaaaaacggaagaagaaatcaaacaactcattgacagctacaacaccaacagagccagtcacgatatttccaatgaagaattggacttgaaaatcttaaacaccaaaaaagcattagtcgcgaatgcggttggcgttattgattttctctacaaacactacgaacggcgattgggtggcgaaggattgattataaaagaaggctttggaaccggtaaagtagaggatggtattgaaaaattcagtggcaacatctatcgcatccttgaaagaaaattgtatcagaaatttcaaaattacggattggtaccacccattaaatcattaatggcggtaagagcaaatggtatagagaataataaaaatgctattttacaacttggcaatgttggttttatagatccagcaggaaccagtcaggaatgtccggtatgtatagaaggacgattggagcataccacaacttgtccaaataaatgcggttttaacagcgaacgtatcatgcattccaacgatggtattgccagcttcaatattgccaaacgaggatttaataattttgtgaaaagtaaaaccgacaagcaataa

SEQ ID NO: 257 - DNA, 3486 bp, unknown
  metagenome-derived sequence
  misc_feature (1)..(3486): Unk48 Cms1 native coding sequence
atgactcaacaaatagaagaaaaacaatcaagtcaaaattcggtttgggataattttgttaatttgtatgccgttaggaagactataaactttgaatttaaaccctcaatttctacaaaaaataggatagaaaaaataatacaagaagaatcaaaattaattaatgcggaaagaaatactattgagatacgcaatttttttaataatcaaattcaagagaatgtaaaactgacaaaaagatattttaacgaaaatctagaaaactttgatgaaattcttaataaattcaaagaaataacaggtaaaataaaaacaaaaaataattacgaaaattttagaatttatgttaatactgataaaataaaactacttgggaaagattttagggattgttatctagcaatgaagaagaaaaaaagctggaaatataaaggagtaaataatacattaaaattgattaagtttaacgattttctaacaatttgtcatttatttgattataacaaagacacaaaaactaatgaaaatgaatttgaaaaattattttctgaaaaaaccgaattactcataaaaaaatatgaatttattaaaaaacagcttaaagatttccttgatgtgaataatgatgtgaataatcaagcagagaaatttattacaaagccggagatattggacaggctcaaaagcatggctttttgtctccaagaaatgatagcagtaatgaatattttttgtgatgaaggtaaaaatgggtcagatgggttccttgcgtttgtagaagatttaaaaggttttagaaaattggttttggataaaaattgcgaagaaataattgatgagattattagacaagcaaaccatattaccaatcccaaagcgtttcattataagtttaccctcaactttaaagcaaaaaatcccaatactcagctctcggggaatgacacatttttaagtgaaaaaaaacttcaagaaaaactgaagcaagaaatggataaattagaggcaaataaaaagaaaaaatcagattgccaaagctatatttcaaagtttgacaattttggagaaaaaaaatgcacgaaagatcaatgggatttagtactaaacaagcaaggattgcctgatgattttgcagaagcgaaaaaacagtatgatgaagcaaaaaaaataaagaaaaaatccgagaaagaaatatccgacaaccaaaatgaaaaaaataattacgccgtcatcaatcagctaaaagcagctttaagaaatagccgtaatactcattttggagtgcttctgaaaaaagacggaaattattatttagctttggaaaataaaatattagacggaaaacttaaagccgataatgaatatgttttaaaaaaactggaaaacaaaaaagcctcttgccaattattgagttatgaatctttgacatggaaagcggtggaaaaactttgtttacttcccacctcttcacttaatgggaaagatgaagatatggttgaatattggggtaaattttgcaaatcggaaataattcttgaaaagaaaaatgacaacgataaaagattgcttttagataccgagaagataaaaacatatcttaaaaaaatcgtatcagacaatagtttatcaaagttttttgatgaaaaaacttttgatgaatgtaaaagtttagatgaaataaaaaagtattttaatgatgcttgttttacaaataaatgggttaatgctgattgggaagaatttttaaaattagacaatgaaggcaaagttgatttataccagattttcaacaaggactttgaactggacgaaaaatttgcaacttctgaaaatgatcagcaaataattgaaaggattaaaaaggcaaaagaaaatttggaaaagaagtttgtgccaaagcataacaatacagaaagaggcaaaagcctttttactatatattggcaaaactgtgttaatgacctcaatgttgataaatatagacttcaacctgaaggaaaaatctatatacgagacaaaagccctatccagaaatcaaaaagataccaagagaaaaaggtattgggagattttggtgtactttttaatcctataacaaaagagattgaccaatcatcaagagatggtaaaacgcggattggaaattttaataattatcttaacaaatattcccgagacgaaatatgtgttattggcttggatcgcggagaaaataatttggtaagctatggtttggtaaaatttaagaaaaaaataatggaagacagcgatataaaagtgcgcttcgataatgagattgcgaatgaatgttgggcgcttgatgaaattgtagaggtaagagatttgtcagctgtaaaagtgtttaataaaaacgggaattgggaaaagagtgagtttgtgaaacaaaaagaagatttttattttactgaaaaaaacggaacaaattatgatgaagaaaaaaataagcagtcagcggaaaataaaaaaaccgaattaaaaaatcagtatcctaactataaagatgggaaagaaagaattgttattattccgataagatacaaaccaaaaaaagacgaagaatttcaaaaaacaggcgcttatgctgtaaaaatactttcgtgggaagaacaagacggcagtgtttataattatagggttgctcaggaagtactgaaagaaaatcgattagaacaaattgaaaagaacaaagatacggaactttttgaaacggaaaaattcaaaaacggatatgtttccgctttggttggatttattgcggaaaaggtaaaaaaatataatgcctttgtttctttggaaaatcttaatataaacaaagcaaaacaggggaattatgaaaaaacctttggagcaagcgtttaccaagtaattgaaaatggattgataataaaacttggatatttgattctaaaaaataacccacaaaattacactcaattagttcccgaaatcagacgaatagaagaattaaagaaaggtaatgatgagaaagatagaaattatcaacttggatttgtacaaattaccgatgaaacaaatacttcaaaaatttgtccgaattgcggttattctaaaaatagacttgaatcagcaaatacagcaaatgggatgttaaaactatcattaaaaactatatcattaaaaaatgatgattttgggatcgatgatagtaaaaagaaaaattttctagtagataacaaaacaactgcttataaatacgcccaagacgggattatttgcgaagaaatcaaaagtggcaatagtgattttgcaaaaactttttgcgatcctcgtcaaaatatgacaaagtcaaaagattttattcgttgcgcgcattgtggttttgattctagatttccgcacaataattgtaaaaaattggaaaagataactggtggcgatactcttgctacctataacatcgctaaaagaggattggaattttcgcaagaaattaaaaaaacttga

SEQ ID NO: 258 - DNA, 3003 bp, unknown
  metagenome-derived sequences
  misc_feature (1)..(3003): Unk49 Cms1 native coding sequence
atgcacaatatgcaatacgaatacacgcgtactattaggtttaatctctctggagagaaggtgagctacatgattgatgtagatgctgcacgaagccttgaagaaacgctggcaaatttgttgatcgcatatcgcgatctgttgggtgtttttaaaaaggcaattttttatgaggataaagaaggagtgcttagagtaaaatctcgtctggaaattaagaaatcatggttgcgtcaatatgcgcgaaaggcattctattcgcttccagaagtgataaggggcagaggatcaaaatttcccgcaaaagattttgagggtaattttttagattggcttcaacgcagcagagacatatatatggatttgaccgatgtcgtgtctcggccggaaaacgataagataaaacggtctgatatatctacttatattaggctactgaaaacgtcagaatattttccgttcgtagaaaaattgctacgaccatggattgcaaatgataaagatacgaacgaatatcttgatgcgttgcgttccatagtggagagatttggacagttacttgatcaagcgttgttggttgtttcaccggatttaacgcaaggtgttgaaattggtcgcgcaagttttaactattatacggttaataagatttctaggaatttcgataaagatattgacgatataaggaataaactagaatcccctttttcggggagtttagataagcaatttttggaaaaagttggtttcaggaaagattcgagtcgcattccaatacaggaactatacgaagatttgaaaaggtttaaggcggaacagaaaaaatcatttttagaagcaacacaagcagatgttttatttgaggatctgcaagtcaagtaccctctttttaaattaaaagacgaccagacgctgcagaagtttaaagggagtaatccacaaaagagaggtgattattatagaaataattggggttttagtgactacaaaaagtattgcgacaacatatttaaaccgattgcgataaaggtcggtaaactaaaagccgaaataagatccctagaacaagagcaagtggatgcccgccttctaaaatattgggcgcatatcgtacagaaagacggtcggcatttattgttgcttattccaaaagatgcgatgcagagagctaaacaatttttagaacagttaccatcaaaacacgaaggtgaatctatgcttatcggtttcaattctttaacattgcgtgcacttaacaaacttattcgccgcaatcttgagagagaacaaacacgattgcaagatgatgctgtttctttatatcaagaagttctcaagggtcagcatcaacgtatccaactagattttaatggttttgagcaagaaataagagaagtcgcaagtggtgattatgcaaacgaggaatcatttcgaatcgcgcttgatcgcgttgcttatgtgcaatctaaggcgcatataaacgaagaacagatggcgaagctccaaaatgattttggagcgttggtgctggatatttcttcgtatgattttgaacgcactatcacaagtgataaaaaagagcattcccaattatgggaggccttttgggatttaaagaatcaaaacaatcagtttcccgtaaggctcaatccggaattgcgtattttttatcgtccccaacgagaccaggaagatatccgaaagcagaaaaatcgtttttcaaaaaatcattttggtgttgcatttaccattacgcagaacgccacgcaaaaccgcatggaaaccgcattccaagaagaaaaagcattactgaagatggtacagacgtttaatcatgaagttattggcacgtttgtagaagaaaaaggagaaaacctttactattatggaatagacaggggggatatggagctggcaacattaggagtggtacagttttctcaagagcggtacgaagccatgcttgccgaagggacggtacaaatatttgatacgccggttttcccgctcgtagaaacatatcgcattaaagaagagcatctgcacgacacaaaagaaatcgctataaacagtacgggcaagacacagacaataacattgtttaaaaatccttcgtacttcattgaagaagaggacaaatttgagaaaggcattagcccgttcatggatttgactaccgcaaaacttatcagggggaaaattatcttgaatggagacgtaatgacatacattgcgctcaaaaaagccaatgcaaaacgacagctttttgaaaagttgtctaaaatagatactaacgcgcaaattgaatttgatgaaataaagaaacaattcaagataaaatcaaaggatagcgagagagaagattgtcaatggctaccattttactctgaagagcaggaaaaagtttttcctcgtgaagcaatgagaaaggaattgcaagaatatcttgataaactgcgtgccgacattacgccggaagaaggcgttagtgtagagaaaatcaatcacctgcgcgatgctattactgccaatatgataggtattatcgcttttctgtttgaaaaatatccaggaattataaatctggaaaatctgcatagcaaagatcagattgaacggcactttagcaataataatgaaaacattgcccgacgtttagaatggagtttgtataaaaaatttcagaaatcaggacttgttccacccaaacttcggcaaacggttttccttcgcgaaaacgagacagaagagggaaagaagctcaatcaatttggcattattcattttgtcccaacaaaaaatacaagtgcgaattgtccgtattgcggggtttctgtcccaatgaaacaaagagagaaagataaatttgagcaccacgcgtatatctgtagaaataattcacaaaattgtgggtttgacactcggaatccaaaacagccgtttgagtatataaaaaactccgatgatgtggcggcatacaatatagcaaaaagtaaaatatag

SEQ ID NO: 259 - DNA, 3432 bp, unknown
  metagenome-derived sequence
  misc_feature (1)..(3432): Unk50 Cms1 native coding sequence; TGA encodes glycine
atgacactacaaaatctaacaaatttgtatgaggttataaaaaccttaaaatttgaacttaaaccaagtattaatacaaaagaaagaataaaatttgataatataaaagacttgaaattattagagaatccttcagaacttttgcaaacaacaaaagaacttgcttctctacaaagatcgatcttttgaattatttttaatttagggtctgaaaatataattatacacaaaaacttaataaaaattattgattctgatgtgttttattattttaaaaataaacaattatcatctatagtaagtttatcagaagttataaaatctataccagaattcagtaatacttttgactgatttatcaaaaatattgaagataatttatcaaaaaatatacacaaatttgaatcatatattttaaatatcgaaaaagtttataccaaaactgaaatttgatttgctatgaagcaatatagtttgcaaatacaaaagtctcatgaagtcatttctttatttgtttataaaacatgaaaaattgatggagaactaaaagaaaatctgaaaaagtacttttcttttgaagatctagaaaatacaataaaaatttgtagtcaaacaatgaaatcttacaatccaactattggatttgaaatacacaaatttggatttaatagtaaatctataaataaaaaagcagatgtggattctttacaaaagcaatgtgaaaaattagaagaagaaatggaaaaacttgaagaacataaaatacaagcaacacagatatttgatgcttatacaaaacaatttaatgattatgttattcactgaaaagaacgagatgaaaaaacttggtgaaaagtatcagaaaaacttatcccttgagatcctaagttagaagcactaaaaaacaatcagacatcttctatacaagaaataaaagaagcaaaagaatatctaaaaagtattagagattgaaattttgactatcaaaaaataaatatagcaaaaaataaatttaaaaaaagtttagtttttgttgataaaataccaaacaagaaaaaagaaaatgaatactattgtttttgagataatatatattgggatcttaaaataaagaaaactaaaaaaagtatattctattgaaagaataagtgagatcttttcgcaaaacaaacagagttatttaatcagcaaaaacttactcattatgctcgtttacttagagataaaaataacttttttgttgctatggttgatagagattgtattctagaacttgagaatataaaagaagataaagatataaaagaagattttcttaaaataatggagtattcatccctcactagcaaggcagttgaaaagcttatctttgaaagaaatgttttgaactttgattttaaagatgaacagtttataatttgtaaaaaaatacgagaaacaagaagttataaagaaaaatgatcaacagaaacacaagcacaaactctagaagaaaaacaaaagttgattcagctagtcaaatttatgaatgatgcaatatgacaaataaacgaaaaaatagaaaactctgtttttgattggaaaccttttgttattaaagatagttttgatgattttgaggaatttagaaaatatattacaaaaagttgctaccaaaccaaacgaacaaaagtttcaaaagataaaatatatgaattagacaaaaaatgaaaaataaacttatatcaaatttataataaagatttttgagtagatccatattttgcaattacagaaagagataaaaatagcaattttatagaaaaaaagcaaaaaccaaatctttttacaatttattggaaagatttatttgaacagaattgagagaatataagactaaatccagaatcaaaactttatcttcgtccttcaaaaaaaatagaagacatagactgaaataattgtgattattgagcaagtaagttaagatttaaacataataaaattattgctgattttcaattagttttttatcctaccaaaaaggaaaaactagaagaaatacagaaaaaaatatacaatgagattaaagaaaaaactttttctgtatgaattgatttgtgagaaaatagtttggctactatttgtcttatagatgacgaaaaaagagttgtgttagaccaaaattgaaatccaattatcaaagatttgactttggtaaataataagtgagggtttgtagatatagataattgttttattgaaaatgaaaattataaaagaaaggacaaactatttatagaaaatgattgatcttattttttaacagattggtatttctcaagttttctatgccaaaaaccaataaaggaactatcaaaagaagaattaaaaaatgttttgattgaattagagaaaatgtctccaaaagagttaaagataactgatacaaattgaaataaagtttttgactatagatatgcttttgtctacaagcaaacagaaaataaaattcgctaccatctacaatcaattggcttaaatgaagaagaaaaaaagtttaaagaactagagctgatggatactactagaataaaatctggttatgtaagtaaattagtttcttatataacagatttggcaaaagagtacaatgcagtaattgtttttgaaaatttagaccaaaaagcaagttatataaaatgaataactttactttcggaggaattatttgaaaatgtatcatcaaaagaaaaaagtcaacttacctgaatttcagtatatcaaaatattcaaaataaaattatcagaaaatgtaatctttttatgcaaaaaacaggtataaacacaaaattacaaattacaccaaaatttaagaacatagaagagtttaaaaactttaatatgacaaataaagataaaaatgtttgacgatgaaatgttatttttataaatgaggagaactcatcaaaagaatgtccaaattgttgatttattccagatactaatccaaaaataaaagattgcaaaatagtatataagtataattgagaagaaaaagaattgaatctagacgatgaaaaaataaaagatagaaaagaatataaaaaaatatgagatttgatgcaaacaaggattaaatatacagatttgtcaaaaagctgaaaatggtatatagattgagatcctatggtttgtgtgaattgtggttatgatacaagaaaagaagcacgagtaaaaaaacacaatctcaaatcttgtgatgaaattgcggcatatatagtggccaaaagatgattagaatttataaaatctcaaaaagtagttgagtcaatatcacaaaaacaaataaacaatgagaaaatagaaatacataaaaatcaaaaaaataacggatttatcaatgaggaatctacaatatctgggaatatagttttttcttgaaatatataa

SEQ ID NO: 260 - DNA, 2625 bp, unknown
  metagenome-derived sequence
  misc_feature (1)..(2625): Unk51 Cms1 native coding sequence
atgaaggagtgtaaatcttttctaaaagaatcatttcaggtagacacggacaagaatcctcattttaaactgtatgcccagcttatccatttaaaagaattcctctctaccttggaatctgcccggcccaaagacacacagagcattgttaaagagactcagaatttgctgagccaaatcaactgggatgctttaggaaaagacaaaaatgacaaaaggactggcaatgattacaaaatttcgatttcctcttggttggaattaaggccgaaaaacgatgaaaaattccagaaagcgaagcagcagattggcctttttcgaggtgggctgaagaataaaataaagaatttcaatgaccttactcaagcatacaaagcggttgctatgaagcttggtaaggcctttggagatatgcgcgacaaaatcactggtgcggccgaactcaataaaatatcgcattatgcagcaattattgaggataagaatgcagaccggtatattctactgaagaaaagtcagctaagcggaggttcccaaaaaccattccagtcaaacgattccggagatttattaatctacacagtaaattcagttacatccgccgccatcggaaagatgctccgaaaaatgagggcagaggaactgaaaaaaaatgaaaaaaatagacaacctcttcctgagttaacagatgaaaaaaaggaaaaggagagtattgaaagatggaaaagctttataaaggagaagggctgggtttccgaattcgagttaaatttggacaataaaacctttgagcagattaaaaaggaagtcgattcaaaatcttatagtcttgatgtcggaagactcagcaaaaatgcacttgaaaaattaattcataatgaagaatgccttcttttaccaattattaatcaggatctggcaagtgaaggaaagattgccaaaaatcagttcacaaaggattggcaaagattgtttgccgatgagccgcagaatttgcgactgactccagaattcagaatctcttatcgacagccaaccccaaactatccagaccccggagagaagcgatactcacggttccagatgatggcgcatttcttagtagattacatcccaaagattgatagttacatttccattcgagaacagacagaaacattcaagaatccagaaaaacaaaaaaaagcagtggcgcagtttcatcaacgtctgaatcctaagagtaaatccgaatcagaccccatcgctcttctatcagcaaaatttgggagccaaattaacaagaaccaagggcgaaaggcgagcacggaggaagctaagcagaaagaggatttttttgtttttggcattgaccgaggacaaaaggagcttgctaccttatgcgtaattgatcaggacaagaaaatcattggtgacttcgaaatctatacccgccagtttaatgcagaaaagaaacggtgggagcatagtttgttacctgaacgccgtcacattcttgatctttccaatttgcgggttgaaacaactctttcgattgatggaattgatcaaaagaaaagggttttggttgacttgagtgaagttaaagtaaaagacaaagagggaaattattctctgccgaataagatgcaaacaaagatgcgccatctggcatatatccggaagctgcaatttcaactgcaaagtaatcctgacggggttttagattttctgtcaaaacacccggaaaaggaaaatgctttagacaatttattagataaagaagaagacgaaaaagggctgatttcgtattacggcgcaggcaatgcgagtgaggatctgccaaaagaggaactctggaatatactcgtcaattttagagaactgaaaaatcaactacaagaagatccggaaaaccaagccttagatcaagaactgagagcactgatagaattggaaccagtcgataacctgaagtacagtgtggtagccaatatggtgggtgtaatagcctatttaatggaaaagttcaactatcaggtttacatcgcattggaagatctaacaaacccgtttgcacctaccaccgtaagtggcatcaccggtgttagtaacaagaatcgccaaggcgaaggaaagaagagtgatgtcgaaaaatacgccgggcttggtctttacaacttctttgagatgcaattgttaaaaaagctgaagcgtatccagcaggaaaatggcaatgttctgcacctggttccggcgttcagggcagtaaagaattatgagaatgtaatcgcaggcaaagacaagattaaaaatcaatttggaattgtcttttttgtagatgccgacagcacttccaaaatgtgccctgtttgtgaatcgacaaatgataagcaaccgaacaaatcaaaatatccagaggcaaagaaggaaaaatccagagaaggaaaagaagtgtgggttgaaagagataaattcaatggcaaagacagaatccgctgttatgtttgcggttttgacacggacaaagattacgatgagaatcccttgaaatatattaagaacggcgatgataatgccgcttatattattgcgacccttgggattaagggatatgaactctcattagctgatttaaacccctaa

SEQ ID NO: 261 - DNA, 3438 bp, unknown
  metagenome-derived sequence
  misc_feature (1)..(3438): Unk52 Cms1 native coding sequence
atgtctgaattgaaatttttaggagattattcttataataaagcaataagatttaaattagaacacaaatgtggagaacttccaaaatttgaaagtaataattccaatccattagatcttattgatttaggtttaaaaattgttgatgattttaaagatttaatatacctaaaaacagaaaaaaacgaactaaaattagataaaaataaatccccaatattaactaaatttgtttctattaaaaagcagtggttaagatattatactaaattagaattttatgatggttctaaaaataaaagtgttgatttttcaataactaattttccatatttgtcagactcttttaaaaaatggattgtggattggacagatgcaataaatcatttaaataatttattacaagataaagaaaatctaatgattagacgatcagaaattgcctattatttattgttaattagtagtaagaattattttaattatataaaagatttttctttttattctaatgataaaaacaccactaaagttgctgaatttcaaaagttaatattaatatttgaagaaaaattaaattcttgtgttattaaatatgccccagcacaaaatgctggtcttcttattgctagtggaagtatgaattattatgctataaataaaaaacctaaagattatgattttgaattaagtcaattgaaaaaagaatatgaaataaaacaagaggaatataatttatttaaagtatataaaagtacccaaaaatctttattatttcaatatattaattctggattagataaagacgaaattttaaaaaaattagcagataattataatttttataaagaaaacaataaaaaaattaaaacattttatagtggtgatagtggtaatgaccttgcctataaatattctagattatttgcagatgatagagcattaacaagtataattaatttaacagataagataaatgaacttaatttaaaactacaaacaaccaacaataataaagatcaaataaaattagaaattagtgcattaaaacagaaacgaggtttctattttataaaaagacaccctcgaaaatctggtgatcctgatttttatatcagtaatgaaaaaaattggcatgatagatacaccttttgtttttcaaattatactaatttttgtaagatttttaaagtaattgcacagaaaacaggtaaattaaaagcaaaaattagagctattgaaaaagaaaaaattgagtctcaaactttaaaatattggtcatttgtagtagatagatctgatgaaaaagaattgtggatggttccaaaagaaaatagaacaaaatttaaggatttattaaaatctgataactctacagatgtaaatatataccaattaacatcattaacaatgagagcattaaataaactatgttttgcagaagaaagttcttttgttaaagatatgccagattatctaaaagatcttcaaaaaaaagtaaaagaagcaacagatgatgagcaaaaaattaaaaatcaaagaaaaaagattaattttagtacagatataaaaacaaaaagcgaacttaaattgtctttttttaaggaacttattaaaagtgagtatgctaaaagcttattagacttatccaaatttaatttagaagatctacaaaaagtaaaagatctaaaagaatttgaaatgcttttagaaaaaaattgttatgttttagaaaaaattggtttatcaaaggaatcttgtgaaaaattaattaaagagtgtaatattttaatatttaaaataacatcttatgatttagaagatagaccaaaaaacacctatcaaacaaaagaaagtgattataaaagaataacctctgaaatatggaatactttttgggaaaacccaggtattaatttaagaattaacccagaagtaaaaataagatatagagaaaaaaatgaagaacatattaaatatttagaagaaaaaggttttgatttaacaaaaataaaaaatagatttattgttgatcaatatacctgttatttcacatttactttaaatccaggcaaactttatcctgaattagtatttgctaaaacagaagagctaataaagaagattcaagaatttaatgatcagtttaataaaattaatttagaaggcacatataaatatggaattgatagagggtctattgaattatcaacattgtgtttagctaaatttgataaaaatgatgtttatacatatacggtagatgataaaacaaaaacaatattaaaaccaaaatttccaaatggagaagaagacattaaagtatatgaacttaaaaaggaactatataataaaaaagcaatttcggatttagagaatttgccaatggaaaaaagaaaaccaaaaagaattatagcaaatatttcttattttatagataagataaatgatccaaattggtttaataaaaaaacagtaacttgtattgatttaactaccgcaaaagtaatcaaagataaaataatagtgaatggagatctactaacctttttaaaaatgaaaaaagaagcagcaaaaagagtattatttgaattggtatcagaaggaaaaataacccctgatcataaagaactaaaatggggatcagaaaatttagaggacccttcttctcgtgaattaagatattacccatatactagtgataaaatagtttatcattttgaaaataattttggaagagatttagaggggttattaataaaagatgatttaatttattcaaaagaaaatgttttaagtaattttcaagtatatctaactgaattattagataataaattagcagataaaaatgaacctaacacgcacacaccaacaattccaaaaataaataatttaagaagagcacttgtttctaatatggttggtgtaattacttatttacaaaaatattatccaggatatgtggttttagaaaatttaaaatctagtgaagaattaaataaatttgaaagaaattatataaatacctcaattccatttgaaaaagcactgattcaaaaattccaaactatggggcttgttcctccgcacataaaaaatttgtgggaaataagagaagagaaaaccaaaaaaaatttgcttgtaaataaacaaaattttcaattaggtgctattttgtttgttaataaagatagaacaagtaaagattgtccatattgcgaaaagccatatacttgggataaagaaaaagctgatgaactaaaatttaaattacatcaatataagtgtgggccagatccttcttgtggttttgatactaaagaattattacctaaatttgattttttaaaagaaatttcagatcctgataaaattgctgcatttaatgttgcaaaaagatggaaagatatagtagaaaatgatgccaagaaataa

SEQ ID NO: 262 - DNA, 3525 bp, unknown
  metagenome-derived sequence
  misc_feature (1)..(3525): Unk54 Cms1 native coding sequence
atggaaacctacaaaacaacaaaaacaattcgctttaaattagaagccgacgacaaaaatattccttacattaaagaggatgtgataaatattcaaacaaataataatgattttaatctcaccgactttatttcggacttaaatatttatttagagaatatcaacaactatttatttgtccaaaaaaaagatggtatatttagcattaatgaaaaaatgaccataaagaatgcttggttgaagcaatatgcaaaacaggaatttgttgctattaaagaacgtacaaatttggaaagcaagcgtagagaacaagttaaaattggcgacataagagagttgatttcaaaaatagaaaaggtttttgattttgttgatcaaacttatgtttctctgatagacaatatttactcagaattaaatgaaagagcaaaaaaagcgcaaataggtttgttgctaaaacgtttggcatcaaaaaatgcgttaccacttttgatggatttgatggaaaacacgtctgataaagaagaaactacagatttaagcattcgaattaaatcaaaatcctctactattcgtagccaattacaagctgctattcaaatgtttttgccggaacaatcaagcggtttacagattgcaaaagcaagttttaactattatactattaataaaaagcctattgattttaaagagaaaattaataaattggaagatagtttacatattaaaagcatggaatctatcaatacttttttcaatagaaaaaaaggaaaacaagatttctatcttaaaaaagaaatttttgacttattaaatactgatatccaaaatgcgtttttggaaaagcaaacatcttgtctttttctcggcgaagttccaatgattgataaagaatatgttagtttgagagatattcttaaaaacataaaagcaaaacaaaaaaaactttttaacgaattaatgcaaaataatagttctcataatgacttaaaaaatagcgaattgtatctttttaataaaatatctaaagagttatttatggattacttgaataaaacagaagagatggaagaggtgggaacggaattaagtaatcaccatctgagagaagaggataagaaaagattaagaagcaagaaagcgagagttacaaaagaacgaggcagtataatgaaagacaactttaaagaatggaagtcttttgcagatttttaccgtatcatttctcaaaagcacggtaaaattcttgcacaactcaaaggaattgaaaaagaagaagttgaatcgcaactattgaaatactgggcgttgattttagaaaaagagaatcaccataaacttgtgcttattccaaaagaaaaagcaggagaatgtaaacaatggatagaaaaggtaaatgagattacaaaactcaataacgaacatgcaaaaatattttggtttgaatcattaacatacagcagtttacaaaaactctgttttggttttgcggaaaatggcaacaatgaatttaatcgcaatatcagacatttgcttcctaaagatgaaagaggaaatcctatcaatggagaatttgcttttggcggagaagagcataagaaaatagaattttacaaaaatgtgttgcaatcagaatatgcccaacaagtgcttcatattccgattgaacaaattaaaaatgagattattttgcacacatttaatagtttagacgattttcaaattgcgctcgagaaaatttgctatcgacgttatgtcgtttgtcctcctaatttggaagatagccttgaacattttaaggcacaggtctttgacattacatcgttggagttaagaaatagtaaaaaaaacaatctcaagtctcatacgcagatttggaaagatttttggaatagtgaaaacgaaataaacagttttaatatcagactaaatccggaaattgccatttcatatcgtgtgccaaaagcaagtcgcattgaaaaatatggtgctaaaagccaaaattacgatcctgaaaaaaagaaccgttttttacatccgcaatttacgcttgttacaaccatcagcgaacactgtaattatcctacaaaagtgctttcgtttgtgaacgatgatgaatacacaaaaatggttgacagttttaacagaaaactacaaaaagagaatgttaaatttgcctttgggttagacaatggcgaagatgaactttctacacttggcgtttatcttccagaatttgaaaaagcaactattgaagaaaaaattgcagaattgaaacaatctcaaaaatatggatttgaagttataactatcaatgatttaaactacaaagaagccgattacaatggaaaagagagaaaaattattcaaaatccttcctattttctaaaaaaggaaaactatatgcgcacattcaataaatcggagcaggagtatgaagatatgttcatcaaattgttttcaaaaaaacatacgcttagtttggatttgactacagcaaaggtgatttgtgggcatatcgttacgaatggcgatgttcctgcactgttcaatttatggctcaaacatgcacaaagaaatgttttcgaaatgaacgaccatacggctgacgaaacggcaaaatccataagacttcgcaacaatgaagaattgacaaataacgaaaaattaaaatttgcagagtatgtttccgacattaaaaaatacgaaaaattatctgttgatgaaaaaactaaatatctaaaatggatttttgaagatagaaacaataatcaattcactgatgaagaacaaaaaacattcaacgacaaatacttaaagaaaaaaggtaattacaattctcctatcatctttgcatcccgttttgaaggtgatgatttacaagatgtaactccaatttttgattgtaggcacgttttcaagaaaaaggaagagtttgacgcaattatgcccattaacgatattgtaacactaattgacagttttaacactaatcgttcaaatcacaatatttcaaatgaagagttggacttaaaaattactgagtctaaaaaagcgcttgctgccaatgctgtaggtgttcttgactttctttataagcaatataaacatcgttttaacggcgaaggattaattgtaaaagaaggatttgatacacaaaaagtaggggaagatatcgaaaaattcagtggaaatatttatagaatcttagagcgcaaactttatcaaaaatttcaaaattatggtttagttccacctattaaaagtttaatgacagtgagaagtgaaggtattaaggataacaaaaatgctattctacagttagggaatattgcctttattgacccggcaggtacaagtcaagaatgtcctgtttgtaaagaaaaaagtaagaaaaagcatacagataactttgattgtcaatgcggattttattcaaaaggaattatgcactctaacgatggtattgcgggttacaatattgcgaaacgtggttttgaaaattttaagaaagaaaaacaataa

SEQ ID NO: 263 - DNA, 3687 bp, unknown
  metagenome-derived sequence
  misc_feature (1)..(3687): Unk55 Cms1 native coding sequence
atggaacctattaaaaatgaattccaactactcaaagcattaggatttggtttaactgccaaacattctgaaaagaaaaataaaacccatgaagaattaatggacttaatccaactatctgaagaaagaattaaaggaaaaacaaagcccaccaacgagattactgaaaagaaaatgcttgaaataatctctgagtgtgtttttttgatgaaacatcatataaacacatgggaaaaggtttacaaccgagcagatcaaataacgctaactaaagaatattacaaagaattggctaaaaaagcctgttttgacgccttttggacagataataaagacaataaacaacccaaatctcaattaattaagctttcttcactgaaaaaacccagatatgaaaattacgaaagaatgggatatatattacggtattggagaactaacatacaaaatctaaaaagaaaaatacatgattttgagttgctattatcccaatacaaattagcattatctaaacaagataaagctcatactaaaccgcaattagtcgatttcaggaaaatgtttctttctatagtcgcgttaatccatgaaactcttatacctttgaataataattccatacaattccttcaattagataaattgccggatggagaggacagcgaaaccgtaaaaacttttgctatagaagaaagagaagagcgtaaataccttgccgcaaaaatcaaagagacgaaggaatattttgaagaaaacgggggatatgttccctacggcagagttacattaaatccctataccgccaaacaaagaccacatattttcaatgaagagattgctgatattatcaaagacttaggtgttgaaaaattaataaaaaaattacaaagtataaatgacatatcaaaatattttgaatttgccgaatctgacaacgacaaaaggaaactcatgaaagattcttcatattccattattgaacgagttcagttttttaaatataaacctatcccagcttctgtctgctttatgttggctgattttttacaaagaacgaaaaaattagaaaaagaaaatgtattggatcttcttaataagataggaatgcaacgaagtatatcaaaagaatataaagataaaaaaagtattaatttagagcagtaccctttgaaaattgcgtttgattatgcttgggaaaatcttgccggacgcatacataattcaacaataccattctctgatcagcaatgtgtcgattttttgcagcaatttggagttgatatcaataatgataatttcagattgtatgcagacttactttttgtaaaaaataatttggctacattggaaaacccaaagaaccaacccaatgacgggtctgaatttattgataatattaaaagaacctttgaaaatataaaactgtcaaaagaaaataacaagcacaaagatgttattttaaactggttgaataaaaacactgaagaacaaaaagaattgaaaaaaggaaacgctcaattattcaaagattatgaaaaggcaaaagaaaaattagggcaattaagaggaatgcaaaagaacagttgtccaaaatataaatccttaactgaagaatttaaaaatctggcaattgactttggcaaaaaattcgccgatttgcgcgacaaactcagagaagaaagcgaattaaataaaataactcattttggagtaattgttgaagattcgcaaaaagatcgttacattttattgggaaaaccggaagacaagttaatacataaatttttaaataatgatcctaacggaaatttaaaaacctataatgttaagtcattaacttcaaaagcattgagcaaaattattaaaaacaaaggcgcttataaagcatttcattcatctcaggtaaaaattgatcgaaaagaaataaaacaaaaatggcaagagtatcaagaccatggcgattttattaattatgtgaaagattgttttgcaaattccccaatgtctaaagaacaaaaatggtcagagtttcaatgcaaattcgatcattgccaaaaatatgaagaaatagaaaaagaattagatgcaaaggcttatctgttaaaagaacaaaatatttctttgcaaacaatcaaaaaacttgtagaacaggaagattgtttgctgcttccttttgtaaatcaagatataacttcaaaaacccgagaacggaaaaatcaatttagtaaagattgggacatgatgtttaaaaaagataacggttatcgtttacatccagaattcaggatattttatcgccagcctacgcccgactatcctaaatcgggcgaaaaacgttactctcgttttcaaatgactgctcgcttactttgtgaatttattcctcagtccgataattatatttcacacaaacaacaaattaaaacttttaataataaagataaacaagaagaagccgttaaagagttcaatgacaaattacatcatcctgacaacttttatgtttttggtattgaccgaggaattaatcaattagccgtactttgcgtattaaacaaagaggggcaaatacaagaaggttttaagatatatacgcgaagttttgatattgaaaaaaaacaatggatacatgaattgtccgaaaaaagaaatattttggatttgtctaacttgcgggtagaaactacaatcaataatgaaaaagtattggttgatttaagcggcattaaaataaaaaacaaggaaggctatcaagataaccgacaaaaaattaaattaaagcaattggcatatattcgtaaattgcaatatcaaatgcacgcagcgccgcaaagaacattggcttttataaacaaatatcatacaccagaagatatgaaaaaacatatacaggaagatataaaagaattgattactccgtacaaagaaggagttaattacagtgatttgccaatcgaaaaaatctgcgatatgttgcaacaatttaaacagtattatgacaaagaggataaaaaatccacaagagaactaactgaacttgattctgctgatgaattaaaaaccggaatagtggctaatatggtaggcgttatcgcctatttattaaaagaatatgattacaaggtttatatttcatttgaagatttgactcgtgcattcggtcgtcaaaaagacggattagacggcagagaattaccccattcaaatgaagacaaaactgtagattttaaaggccaggaaaatgcggcattagccggactcggaacctatcactatttcgaaatgcaactacttagaaaattattccgcatccaacaggaaaacaaagatattttgcatttagtgccggcattcagaagcgttgacaattatgaaaaaattgtccgacgagacaagaaatcagacaatgatgaatatgttaattatccgtttggtatagtgcggtttgtcgatccgaggaatacctctcgaaaatgccctaactgtggtgagattaaaaaacaaataataacacgaagtaaaaacaaaataacttgccgtaaatgcgggtttataacaggcaataacaaccatgacaaaataaaggataataaaaaagataaaaacttacattatattaccaatggcgatgataatggcgcataccatatcgcattaaagacattaaaaaatctaaaaggtcaataa

SEQ ID NO: 264 - DNA, 3633 bp, unknown
  metagenome-derived sequence
  misc_feature (1)..(3633): Unk56 Cms1 native coding sequence
atggaaaaggacaaaattacagcaattagtgaatatcaaacacaaaaaaccattagatttggcttaactgcgacaaatcaaaatctgtattccgaagaaatcatggaattattgaatgtttcggaaaaaacaataaaagaacaagtagaaaaagtaaataatgatattgataaaaacaatcaattaagatattgtttggagcaaataaaaaaatacatagaaacttgggacaatgtttattatcaaattgatttttgggcaattacaaaagattattataaggtaattgcaaaaaaagcaaagtttgattttgacaaaggaaatggctctgaaataaaattatcttccttgcaatcggctcataacaacaggaaacgctatctctatattatggacttttggaaagaaaatttgtataaaacagaaaatttatatcggaagtcagacaatttgttgaaagtatttgaagaggcggaaaaacaaaatcgcaatgataaaaaattgaatgaggtggaattgcgaagaacttttttgagtttatttaatcttgtaaatgaaagtctgaagccattaattgaaggaaatctgtttattgtaaatgacgacaaaattgacgagcaaaattcaaatcacaaatttgtggaggattttatctcaaaaacagacgaaagaaaacagttatatgactgtattacggaattgcaaaaattttttaacggcaatggcggttatgttcctttcggcagaataacactaaataaatggacggctcaacaaaaaccgcatattccaaaagataaaaatggcaataatgaaatagacaaaattatttcctttttaaaaccagaaagtgtttcgatgcaaaatattgattatgagtacgatgcatttgaagataattttgaacagatagataataagtggaaattaaaacagaatgcaaaatctgttatcgaaatctgtcaatttttcaaatataaaaaaatcccagtaaacgctcgcttaaatcttgcaaaacgcttgaataaggacattcactttttaagtgattttggggtttcaaaatcaccggctttggattacaaaaacgataaagataatttcaatctcgccaactatccgctaaaagttgcctttgattacgcttgggaaaattgcgccaaagcaaaatatgaaacaataacttttcctgaacagaaatgtaaggattatttgaaagatgtttttgatttaaatgttgatagcaacactgattttaccaaatatgctttattgttgcgtttcaagattttagtcggaagaattaaagcagaagaaaatacacgaaaagaaaatattgaaactgtaagaagcttattgaaagatgtaaaagataatctttcaaaagaaaaagacaaaacgataacatccgttgaaaattggctcactttcaaagaaaagcaaacagataaaaaggaaaaatacgaaaatcaagacgaattttccaaagtgatgcaaactatcggacaagagcgtggcggattaaaaagtagaatttcaaaatataaaacattaactgaaatgtttaaagtttgtgcttcaaaatttgggaaacaatttgccgatttgcgagattatttcaatgaagcgtatgaggttgataaaattaaatatcgagcttggattattgaagatggaaaactaaatcgttttgtattgcttgccgataaaacaaaagatttgaatttagaaaatgataaaaacggcaatttgaaactttacgaggtaaaaagtttaacctcaaagtcacttgtgaaatttatcaaaaacaaaggtgcttatcctgattttcatatagtcaacaatcggcaaatatatctaaattcaggtggaaaagataatcgtggtaactttattgacgatgtaaaaatccattggagcatatatcaaaacaaccaaaagtttttaaacaaactaaaagactgttttcaaaattcaaaaatggcaattgaccaaaattggaacgaattcaattttgatttttcaaattgcgatacatacgaaaaaatagaaaaagaaattgatagaaaaggatatattcttcaacaaaattctatttcattagataaggtaaaagatttgataaaaaatcaagaatgttttttgctgcctatcatcaatcaagatattaacagagaagacaagcaggcaaaaaatcaattttcaaaagattggaacgatatttttgtaaatacaaaacgcttgcatccggaatttaatcttttctatcgctttccaacaaaagattatccgaatacaaaattcaaaaatggaacagaaaagacaaaacgatattctcgtttccaaatactagctcatttgggttgtgaagttattcctcaaggtaattatttaagcaaaaaagagcagatagccatttttaacgatgatgaaaaacaaaaaggggaagttaaaaaatatatcaatatttgttctgattttgattgtgttataggaattgacagaggaataaagcaacttgcaacgctttgtgttttagataaaaatggcagtatacaaggtgattttaagatatttacacgaacttttaatcacgatacaaaacaatgggaacatcattttcttgaaaaacgcaacattttggatttatcgaatttaagagtagattccccaatcactatttgttgtaatattcctgacgataatcacaaaaaagttttggttgatttggcaagtattcaaacgaaaaatggcgagaatcaacaaaaaatcaaattgaaaaaactcgcttacatccgtgaattacaatatgccatgcaaacgcaagatttgtccgaatttgtaaatagtttgaaatctgccgacgatattacacaagataaaatcaaaaactttatatcaccatacaaagaagggcctccttatgcagacttaccaaaacaagaaatgtttgatttgcttaaagaatgggaaaatgcagatgatgaagaaaaacaagtaattgccgaacttgattccgctgataatttgaaatcagggatcgttgctaatatggttggtattgtggcatttctttgcgaaaaatataactacaaagttcgtattgctttggaagatttaacaagaagttatggtatccaaaaagatgcgttaagcggaacaacaatttttcaaaatgatgaagatttyaargagcaagaaaatcgaagacttgcyggygtaggaacaatgcaattttttgaaatgcaacttctaagaaaattatttaaaattcaggttgataaaaatttacatcttattcccgcatttcgaagtgtagccaattacgaaaaaattgttcgtagagataaacagaatagcggcgatgaatttgtcaatcatccttttggaattgtgtgttttgttgacccaaaatatacatcaaaaaggtgtccgaaatgtggaaaaacaaatgtcgatagaaaagaaaatattgttatttgtaaagaaaagagttgcggctttcaaaccaaagaaggaaatcctttcgaaaagaacaatattcatttcattactgacggcgaccaaaatggtgcttatcatattgcaaagaaagtattgaaaaaagacagcaacaacgaaacaaaaaaataa

SEQ ID NO: 265 - DNA, 3447 bp, Lentisphaeria bacterium UBA7640
  misc_feature (1)..(3447): LbCms1 native coding sequence
atgagtaataaaatgacataccaatacacccgcgcaataagatttaaacttaataacccttcaaaaaccggattttatcacccaccagaaaataaaaaagtagacttgaatgatcttctctcaaaaacagactcggttaaaaatgacattaatgacctcctattctttgacggtaaaattcaaaagaagttagaagtaaaaaagaactggttattattgcaccataaaaatgaattcattttttacaccaaaaataacagaagcaaaaagtataaactttctgagcttaacttaaatgcgaatgacgaaaattattttaaaaatcgtcttggtattctactaaatgactggactcattatacctccatattagcagatgcaaacaaccgaccagacgaatcacttattagaaaatctgaaattgccaatgccgttcgctcactattaaacaaacacatattgggatatttaatagacttattgaacaatctttcaagttcaaatgattatcttcttgatggcaaatgtgatgagttaaaaaacaagttgtgttctatcagagaatatctgcaatttttagaaacagagtatttagcaagtcagtcgtctggaattgaatgtgctcgtgccagcttcaactactttaccgttaacaagaaaaataaagaatattttgacaatcagattgacgaaatccaaaaagagcaagcacaaaactatggagaaatcaaagacaacaaactcagtgtcatccaaaggggagatattatttttgattttaaaactgagcaagagaaacaatggttaaagctttatctgggaaaaaatgatataaatgacgaaaaattaacaaaacaacaaacggttactttgctggcaaactttaaatcagaccaaaagtcaattttccatgaagtcttagggcattctcacagtgatgctaaaaatacaatttatacaaacaataatcgtaaactatcaataggaacatcaaatatttcttataagtcaataacgcaagtgagtgatttagagagtcagttttctttatttaacctgaaaggtgataaaaaaacattcgataagttattaaaccctcataaaggaaacaaaaatgtaaaacacttcttttgtggccaaaatccatatttccatcttttcaaaaaatattgcagtaattttgctgacgttgctaaagaaaatgggcaattgacttctcagataaaaaacttggaaaaacaaaggcttgaatcacaacgtgcaacctattgggcaatgatatataagaaagatgaaagtgtaaaattactattgattccacgtatccaaataatggattccagaaaatatattgatagcttaaagcaagctccaaatggcaatctatttgtattgcaatctttaaccatgcgtgcgttggaaaaactttgctttgcggaagaaagtacatttgtaaatgatatggatgccgagttaaaaagtttgcaaaaaaagattaaagaaaccgttacagaaccgacctcgcatgaaaagaaagctggatcagtagataaaatcagagcagaaaaattagccaataaactaatggaaaagttaaaatttttcaagaaagtaataatggcgcaatacactcgtgatagaattgacctgaatcactttgatttatctgcttgccaaacagcagaagatttaaatgcctttgaattagagttggaaaaagcctgttacaagttcacaacctataaattgtcagagcaggaatacgataaatttatccaagattttgacatacaaacatttgacatcacctcttatgatttagaggggcgcaataaatcatcagctccggaaagtgcagaccgtaaattcactaaaatatggaaccaattttggaataatgaatcaaacaatgaatttggaaccgttcgattaaaccctgaattacgaataaactatcgcgaagccgactataacctgaaacagttttttgagaaaaaaggattttctaaaatattcaaacatcgtcgtttgcaagaacagtacaccgtgacgttttcttttgctttgcaagctggaaatatttatgaggatttaagttttgttaagcctgaagaccaaatagataaaataaataagtttaacaatcaattcagagaaaaaatgccttatgattccgcatggaaatatggaattgatgttggtcagattgaattggcgactttatgcttgaccagaaaaacagatcaattttattcggcaaataatgaaatattttgtaaatatgaattcccggaaattgaaatttataaattgaaggatctgaatcataacgagaattatgacaccaaaacggaaacaaacaaaattcgttatgcaattaaaaatatctcatattttattgatcaggtcgaactttttgaaaaatacacgacagcaacgatagacttgtctactgcaaaactgattaaaggaaaaatcgttactaacggggatttgataagttatttaaagctccaaaagcttgttgcaaaaaaacgtgtctatgaaattttccaccgtgaccaaattgattatcaagatactatgtttatcgaattatctgatctaaaatataaccacaatggcagagaaaaaactccaggtgaattgcatgtgagtgttatatttaaagaacaggaaaatacaaaccagaaagaaggtcgaactgttttctcgtttagaaaagagtgggcaaacttgacaggctacactaccgctgacattgaaaatagtttaaaaatatatttatcagatattcaaactttaaccaaacaacgcaagtcggataagcgtcttggaaaagacgtacgtcaagaaaatttgcacacgccaactttcgaacaaattaataatttgaagcaagctcttgtagcgaacatggttggtattatttgtcaccttcaggaaacatatccaggttacatttttttagaggatttaaaaaaagcatcgattgacaatcaatttaaccagaataattcacatattgctcgaaaattggaattttcgctttataagaaacttcaatcccttggcctggttcctccacatataaaagatatagttgcattgcgtgaagttataagaaaaaaagatgacaagttcaactgccagttcggcataatgattttcattaatgaagagaacaccagcaaaacatgtccatattgtcgtaaaaaatcaagaaaagacaatgtaaaaaaaatgcaaaaacatgcttttgattgtgaccctgaaaatgactctgcaagttgtgggtttacgacatgcagtacgaaaaaagaattccaatttttaaaatccattgacaacccagattcattagcagcttttaacattgcgtcaaaaatagatgacaaagatttattaataagattgtctttgcctgtgaggcatggaaaacgatga

SEQ ID NO: 266 - DNA, 3660 bp, unknown
  metagenome-derived sequence
  misc_feature (1)..(3660): Unk57 Cms1 native coding sequence; TGA encodes glycine
atgaaaaattttacaaatttgtatgaggtgcgaaaaacaattaattttgaattcaagccctcttttagcactcaaaaaagagtcttgaaagataggattaaagaaatttcaactttcaaggatgaagataaacatattattgatattatcgatttttttaataataaaaatcaagaagctgtgattcaaacaagagaatatttcaaaaatgagttagatttttttgatacagtttttgaatcttttgttcaaattatgaataaaatagagtcaaaaaaaaattatgagaattttagaatttatgtaaatactgcaaaaataaaactttttggaaaagattttcgagattgttatcaggaaatgagtagagcaagaacaagaaaagggagaggttgggattattattatagttttaatcaagggacacagaaaccagagtttaaaacagttcgatttggagattatattaccattcatcatttgtttgcatttcagtatgataaagaaacaaaaataggagaatttgaaaaactatttttaaataaaattaaacttattaagcaaaaatatgaatattcaaaaattgaaatattagattttttaaataccaaaaatcaaactgagaagtttattactaaaccagagattttagatcgactaaaaaatatggcttattgtttacaagatattctgaaaataataaatattttttgtgatgaaggaaaaaatggatcaaatggggatgcctcttttttaaaagatttagagggaattaggaaattattagaagaaaaaaatattgaagaagtaacaacggagattattaggcaagtaaatcaaattataaatcccaaagctcatcattataagtttacccttaattttaaagctaaaaatccaaatattcagctttctggaaatgatacttttttatcagaacaagaaattcaggaaaagttaaaaactgaaatggacaatttggagaaaaataaaaaagataaatcagattgccaaagttatatttcaaaatttgagaatattattgatgaaatattaattaatgaaatatttaaaaataaaacgaaatttatagataaaataaacaataataaaaaatttattgatgaggcgtgggataaggttaaaaacaaacaaggattccctgacaattttgaagaagtttttttaaaatataaaactaatattaaaacaaaaaaatctttggatacagatattgctagtaatcaaaatgaaagaaataattatgcagttataaatcagctaaaagcagctttaagaaacagtaaaaatactcattttggagtgattttagaaaaaaataagaattattttttagcactagaaagtaagattttaaataaaaaattaaaagcagataataaatatattcttaaaaatttagagaataaaaacaatttttgccagttgcttacttatgaatctttaacctggaaagccgttgaaaaactttgtcttttgccaacttctttgcttaatggaaaaaatgatgagataattaagtattggagcaaattttgcaaaggagaaattattacagagaataaaaaagatggagatacaagagatttgttaaatattccaaaaataagaaaatatttatctgaaattgtaaaacaaaataaattatcaaagttttttaataaaaatgaatttgaaaaatgtgtgactttagatgatatgaaatcatattttgatgataattgttttgtaaataattggattgaggctgattgggatgaaatttataagttagatgaaaatggcaagattgatttatatcagatttttaataaagactttgagcttgaagagtcttttgcaacttctaaaaatgataaagaaatagttaaaagaagaaaatcagcacaagagaaacttggtaatgattttgtttcaaaacaactaaatacaaaacgaagaagaacactttttacaacatattggagtaattgttttgatggctttgataccgaaaaatatcgtttacaaccagaaggaaaagtttgtataagaaatataagtcctataaataattctgtaagatatacagaggaaaaagtgcttggagattttgggatattatttaatccaataacaaaaatagttgatcaatcttcaaaaaagggaaaagagagaattgagaactttaatagttatttacaaaaatctattccaaaagatgaaatgtatattattggtttagatagaggtgaaaacagtttagtgagctatgctcttgtgaagtttaaaaagaaaagattagaaactgatgatataagtgtacgatttgacaatgaaattggagaaaaatcttgggtacttgatgagatacttgaagtcaaagagttatcggcagtaaaagtttttaatcaaaaaggtaaatggaaaaaaagtgaatttgtagaacaaaaagaagattttaactttgttcaaaaaacaggagagaactatgatgaagaattgaataaaaagaacgcagagttcaaaaaagaagaattgaaaaaacaatatcccaattataaaaacaggaaaggagaagataaagaaagagttattattattccgatgagacaaaaggaaaaggagaaagcgtgagttagacaaataaaaacgggggcatattcagtaaaaatttgttcttggaaagaagatgatggaagtatttataattatagagttgcacaagagataattaaagaagaacgatttcgacaacggaaaaaacagaaagaggataaycttattgatactgaaaaatttaaaaatggttatgtatctaattttgttaattttatcgcagcaaaatcagcagaatatggtgcttttgtgtcatttgaaaatctgaatatttcagggggaaaagatggtaatttagagaaaacttttggggcaagtgtctatcaagttattgaaaataagctaatgagtaaattggggtatttagtgcaaaaaagcattccaaataatcacttacaatttgttcctaaaataaaaagaattgaggaattaaataaagatattgtttcagaaaataataagaacaaaaattaccaacttggttttgtgcaaataaccaatgaaactaatacttcgaaactatgtcccaattgtggatattcaaaaaatagatataagtcagcagaaattgaggatgaaatgattaatttggagctaaaagatctaaaattacaaaatgaagattttgggataaatacttttaaaaaaataaaatttcaaatagataacgatataaaagcttggagatatgcaggagtaactacagagggattagatttaaatcataaagatttttgtaaagtgatttctgatccaagacaaaatataaaaaaatcaaaagattttattcgttgtgtgtcttgtgggtttgattcacaatttcctgaaaaaaatcatagtaaatttgaaaaaataaatggtggagatgttttagctgcttacaacatcgccaaacgaggactagaatttatcacacaaaaaaaccaatcatgaccatcctcaatactgcatgcaataattttacacaaaaactggataagtattaagttttgattaaattcactactatttataaataagaaaatctgctataataggtag

SEQ ID NO: 267 - DNA, 3585 bp, unknown
  metagenome-derived sequence
  misc_feature (1)..(3585): Unk58 Cms1 native coding sequence; TGA encodes glycine
atgcaagaatttaaaaatatttatgaaattaggaagagtttgaggtttgagttattacctacaaataatgaagatatcttaaaacctaaaaatatagattatgatttaaatgaatttgtggaaaaattgaaagattttttatataaatttaaaaatactatcttttattattcagaagaacaagatatagaaaaaatgaattttaggaaatgattagaaataaaatatgtttggttaaaaaattatacaaaaaatgatttttataattgaacaaagaaaaaagataaaacatataaattaaatgaaattatttatttgaaaaaatattttttttacttttttgatgaattgtatgaaattattttaaatttggaagaaatagtacaattaccaaaagaaaatcaaggtagaaaatcaaatatagcttattatctaagaaagctaaataagaaagatgtaatagattttatatatgattttttgaaatatatacataatccacaaaatccaaaaacagataaatttttaaatgatttaaaagaacaaattgaaaatataaaaaatactttattagaacttaataagcaatttttacctttacaatcttcttgacttgaagttgcaaaagctacttttaactattacacaatagataaatatagtaaaataaattttgataaacaaatagaaaatagattaaatgaattatataaatcaatatttaaattaaataatcacaggttatttaaggtttggataaataaagaaaaaagaaattttactataacaaacaaatttttagaaaaaatttgattttttgattatttagaaaaagaaagaaattttttaaattttttattatctaagctagaaataaataaagaagaaattgaaaacaaaattaaaatattagataaagtattagtaaataaagattttaaagtattaaatttagatgaagcttatgaattaataaaagaatttaaagcaaatgctaaaagtcattttacttctgatttatgagcttttgaatttagaaaatttaaaataccttatagtaaaataacaaaagaaaataaaaaggataatatagaaggaactttggaaataaactatgaaaattttttaaatattcatcctttgtttgaaataagtgatgatgattttaaaaaattaaaagaattaactgaagaaataaataattattcattaaagaaaaataatattttacaaaaattaaaattaaaaaaatctaaattggaagcacaaataaaatctaaacaaaaagaaaattgagaattgaataaagaagaaaaagattttttagaatatgataacaaaatttgagaattaacacaaaaaaggtgaaaatactttaataaaccttgagaaaaagtatattcttggaattatttttatataaatgaattttttaagaatattgcattagaaagaggaagaataaaagctgaaattaaatgattggaggaagaaaaaaatcaggcaagattacttaaatattggtctttaattacagaaaaagatgaaagtaaatatttaatattaattccaaaaggaaatagatgaaatgtaaaagaaaagttagaagaattttgagaagaaaaaaatgatgttactatttattattttaaatctttgacattaagagcattacaaaaactatgttttaaatctagagaagtaaatacttttatgtgggggaaaaattgagttgcatatgaattattgcaaattaacttagataaaggatatattaatattaataaaaaatgaaaaaaacttttaaaaagatatgatgaattaaaaaatgaagaacaagaagtgatacaattttatcaagatgtattaaaatcaaaaaatgcaaataagcaattggatttagttgattttggatgattagatgaagttttaaataaaaattattcaagtatagaagattttagaattgatttagaaaaagtttgttatgtaaaaattccaaaacagatatcaaaagaagattatgataaattattagagaaaaataatattttagaatttgaaattacttcacaagatttaagaatacaaaaggaaaattatgagaatttaaaaaatcataaaaataaggagcatactaaaaaatggctaaatttttggtcagaagaaaataacaataaaaattatcctataagattaaatccagaaataaaaattttgtatagagaagctttgcaagagaaaaaatgagattataaaaatagatacacaaaagaacaatttacacttactaccactttatgatttaatattccaagtaaaaaatttgattttagttttaatgatactagagatataaaagaaaaaatagataattttaacaataaatttaataaagaatttaattgaccatggtattatgggatagatagatgaataaatgaacttgcaactttaacagtagtgaaatggacagatgaaacttataatacaaattgaatacaaattaataaaccagaatttgcagaaatagaagtttataaattaaaagatgaaaataaaaaattaaaaattataaattataaatgagaagaaaaagaagtaaatattatagataatatttcatattttttagatcaagaaaatttgtttgaaaaaataataacttcaactattgacttaacacaagcaaaattaataaattgaaaaattgttttaaatggtgataaaaatacttatttaaaacttaaaaaattatctgctcaaagaagattatttgaattattttcaaaaaatttaattgcaaaaaatagtcaatttgaagcttgaaaaaaaatattatttgtaaaaagaaatgataataattatgaaccaatttattggtttacagaggagcaaaaaaagaataaagaattacaaaaagatataatagaagaattaaaaaaatatttagaagatttggaaaataaaaatatatttgaggatactgaaacaatagaaaaaataaatcatctaagggatgcaattactgcaaatattgtttgaattatttattttttacaaaaaaaatatccttgaaaaatatatttagaaaatttagaaacaaaagctcctcaacaagaaacttttagttttaaaaaatgaaaatcttgagattatacagaaatagaagaaaaaatgatagatggacattttaggcagtcaaatacagatatcagtagaagattagaatggtgattatatagaaaatttcaagaaagttgatttgtgccttcaaatttaaaacaaacaattttattgaaagatgaatttaaacaataccaatttggaattataaattttataaaagtaaaggcaactagttcaacttgtccttattgtgaaattgttacagaaaataaatgatgattaaaaaaacatataaaagaagataataactgtaaattaaaatcaaattttcaggaagataaagataaaataaaaaattgtatttataaagatctatataataattatcaaattaattatgatagtatagctagttatactattgctaaatttggaaagaaaaatttatttaattaa

SEQ ID NO: 268 - DNA, 3807 bp, unknown
  metagenome-derived sequence
  misc_feature (1)..(3807): Unk59 Cms1 native coding sequence; TGA encodes glycine
atgattaatctagaaagttttaaaaacttgtatgaagtgaggaaaacagtcagattttgattaaatcaacctagaaagaaaagtgatattaataaaacgcattgactattaaaagatttggttgagatttcttttgagagagaaaaaaaactaattaataatgaaaataatcacgtactaattgatacagagaaagttcttatagagaaattacagcaatatgtaaattgactagaagtacaactaaaaaactggaaatgagtatatcaaagatatgatttaatagctataaataaagactactataaaatattggcaagaaaagcaaagtttgatgctatgtgggagattactaaatttgataaaaaatcaaataaatatataaaagttaaacaaccccaagcaagtcaaatttctttatcatcattaaagatttgaaatagaagtgatagtattattcaatattggtgagagataagtcagaaaacagattatttacttaatatttttaaacctaaattagaacaatacgagagggctattaatgatgctaatagtgctcatattaaacctgatagtattgactttagaaaaacctttttacaacttttgaaactaactaaggaatttttacaacctttattggatagatcaattattttcgagctttcaaagaagaaagtttctcaagaaattgaaaagatttctgagtttgcttgagaaaaaaataatacaaaaatttataatgtattgaaaaattgagaagaacttagacaatactttgaagcaaattgatcccaagttccatattgaagagtaagtctaaactattatacagcagtacaaaaaccaaataattttgatcaagaaattaaaaaagctatagacgatttatgaataataaattttttgaagaaaagtgatagtcaaatgatcgattatcttcatcaaggatcaaaacagaaaataaaattgttacttacttcaaaacatccttatcctattgagttattacagttatttaaagtaaaacctattcctttttcagtaaagtataatttggcaaagttcattgagaaaaattataagaatgaaatcagtttatcttatgaagagattttagataaattgaatttgttatgaagagctattgatatcgcaaatgattttaaaaattccaataatcaaaataacttttctcttgatgaataccctgtcaagttagcctttgattatgcttgggaaaatacagcaagaagtttaaaaagaactatacctttcccaaaagaggtatgtaaacaatttttaaaagataattttgatgttgatgtcgataatgcagattttaaattatatgccaatcttttattcatagcggataatctagcaattattgaatacaataatccaaataatgaagtagaacttataaataagataaaacaagcatttgactctatagacttttcttttgataaagaaagatattgatgatataaaaatgatgttttagtattgctaaataaggcaaaatctcaaagagactattccactatattaaaagcaaaacaagaattgtgattattgagatgatgactgaaaaataagattaaaaaatacagagatttaacacagagattaatagacaaaaagaattcacatttttgaatcgcgagttttgtaggaaaaacacttgctaaaataagagatcgactcaaggaagaaaatgaactcaataaaatttctcattacggagtaattcttgaagataaaaatcaagataaataccttcttatattacaacttgatggaaaagatacaagagaaaaaatatctcaaaaacttggcaatggagacataaaggtgtatcaagtaaattcttttacttcaaaagcattaaataaatttatcaaaaattcttgatcggaagatgcaaaaaaatttcactgagattttagatataaacataaagaagtttcaatatatgatgaaaaaggaaaatggacatgatatcaggaaagttttttaagtcatataaaaaagtgtttaattgactctgagatttcaagagaacaaaattgggaagcctttggttggaattttgctggttgtaatacttatgaagagatagaaaaagaaattgattctaaatgatatcagttgactgaaaactctattttaaaagagactttaggaaaattgctgaaagatgaaggttgttcgttatttcctattattaatcaagatatttcaagtcaaaaacaagaaaataaaaatatttttactttagattttgaaaaggtatttgagtgaaaagaatataggattcatccagaattttctatcttttatagaaagcccatggaagaacacgagaaggagaataaatcgtgaatcataaatcgtttttgaaggttacaattattggcaaatcttggtatagaatttattccaagaaattcttcttttaaaacaaaaaaagaacaaaatagaattgcgattgatcaaaagaaacaaaatcagttagtccaagagtttaaccaggaaaaagtaaatacatattttgaaggattagataattattatatttttgggatagatagatgaatcaaacaattggcaacattatgtgttactgataaagattgagttatacagtcctttgatatttacacaaaattttttgattctaaagaaaaaatttggaaatatacaaaaactagaacggaaggtgttcttgatttgacaaatcttaagatcgaatctgataaaaattgaaatacttatatagttgatatttcgttatttgatgcaaaggatgaagattgaaatcctacaggtacaaataaacaaaatattcaacttaagcaactggcatatatcagaaaattacaatatcaaatgtctgcaaatgaagaatgagttttaacttttttgggaaaatataagaacaaagaggaaagagaacaaaatatgaaaggactaattactccatataaagaatgaaaaaattttgcagatttaccaatggatatttttcaagaaatgtttgaaaattattatagattaaaaactgatcaaaatttgtctgaatctgagaagaaaaatcttatgaagatcactacagagcttgatgcaagtgaaagcttgaaaaaatgagtagtcgcaaatatgataggagtgatttattatttgatgaaaaaatatgaatataaagtgaagatttctcttgaagatctttcaaatgcttggtttttttcaaaagacggactttcttgagatgttgtgctaaatacgaaaaatgatgaaacaatggatttaaagaaacaagataatctagcgcttgcttgagtttgaacatatcatttctttgagatgcaattattgaagaagttatttaaaatttctaccgaagaatgagttttgcatttagtcccaagtttttgaagtgtaaaaaattatatagagattatgaagataaaaggaaaatatgtatacaaacaatttggcattgtttatttcgttgatccaagaaatacaagtagaaaatgtcctgtttgttgaaagtgatgaaaaaaatatatctcaagagttgacaatattgtaacatgtaagaattgttgatttgatacatcatcagacaattccatccttataaataattatgaaaaacaatgaaaaaaacttcattttataaaaaattgagatgataatggtgcatataatatttgagagaagataagagaacttccaaaaaaatcagatgtaaagaatacctcgatttcatgaaatatttctttttcatag

SEQ ID NO: 269 - DNA, 3324 bp, unknown
  metagenome-derived sequence
  misc_feature (1)..(3324): Unk60 Cms1 native coding sequence
atgaacaaaaacaatatgcaaaaaatgcgagattgtaaaattccttttgaacttaggaaaacaattagatttaatttgcaaccaaaaattttaaaaagacctcatgaattgacagaaaacgacaatgatagtttgactgaacagattgcgaagtttactaatgaatatgaatttgttattcaaaacttagagaggctggtattttttacatctgaagatggtcaaaagaaagagttgaggaaaaaagtttatgttaagcacgcatggcttaggaattacacaaaaacagaattttatgatggcaaggactgtattttatataataaaaatgggataaaaagaagcaatcaaatttcaattgctgacaataatgtaaagtttttagaaaattattttacaaattggataaatgaaaataatgagtgtgttcaaaaattgcaaagatacttggagcgaccggaatataaacaaaaacgattttctgaatttgcttattggattcaaaaagttttgaagcgcagcaactttgaagctatttttgaattatttaatagtaatattcaacataaaagtagcgataaagatatatctgcgattaaaaaagaacttgttgcaatcaaaccgctcttaaaatctctcacaaatgaacttttgcctagtcagtctctgggcgtggaaattgaacgagcaagttttaactattatacggttaataagaagcctagaaattatagcgaggaaataaaaaacaaagaacaggaaaaaaacaaaaaattattttcttttaataagcaaagtaaaaagatgtttattttagataataagattaaatttttgaaagaggatatcagacagttgaatgacgattattttgttgaagagatttttagtaaagagaagaaggtgattaaagattttaaccacttaaaaataagtaaggcatataaatttttgaaagaatacaaagcaaatgaaaagtcaagattttacgagttacttgaaagtggaaagacaagtgaagagataaaagcagagtgtccattgtttgaatgttcggataaaaattttaataaaatcaaagatctgacaaatcggattgaaagaacaaaagatgaagatcttagggaaaatcttaaggaagaaagaggtaaacattttgatgttgttggagaagaaggtaatatgtgttcttttgacaaatataaaaaattttgtgccttattccaaaaaattgcgatgcaacttggtcgtgttaaagcaaatgttaagtcgttggaaaaagagaaaattgatgctgaacgattacaatcttgggcagtgattttggaaaaagataatcaaaaatatatcttaacgattccacgtgattcttggggcaatttgcgtgaggctaaatggtttattgatagtttacaaaatgaaagtagcacggaatggaaattgcattcttttgagtcgctaaccttgcgggctttggataaactgtgttttggttcggataacactttttctttggcgattaagggtgagttaaaaataaaaaatagtgtgttttttgatggagaaaaaataaaaagaaaagatcaattttccaaggatggtttggaattaattcggttctatcaaacagttttagagcttgagacgacgcgcaaaactttggcgatagaaaattttaagggattggcggaagttattgaaaaagattatgagaataaagaggactttgaaaaggatttaaaaaaggcttgttattacaaaaaaaccgttttaatttccgagcaaaccaagaatgaaatcattgaaaagtatcaaggaaatttgtataaaataatcagctatgatttggaaaaagatgatcatgaagacattgcgaaattagacaataagaaagaatttaatagaaacaatctggaaacccataccaagtattggttgtatttttggactagggagaacgccaagagtaactatcatgttcgtttaaatccggaatttagaatcaattttgtagaagaaagaacgggagagttagagggtaagcaattaggagcgttaaataaaaatagaaaaaagaataataaattcttactttccacaaccataactctctgggcacacgagaagaacattgatttggctttcaagacaacagatgagatttctgggtttattgattcctataataaaaagtttaatcaaaagataaagccttttgatatttattattacggattagatcgagggaaaagggagttgttaactttaggtttatttaagttttctgaaaccgagaaggttcaatatattatggaaaatggagtggttggtgaatataataaaccggaatttattgatatagcggcctatcaaataaagccggaaaagtatttagaaaaaaatgacaaagggagagttgtgtacaagagcgcttctgaatttgtggaagattctgatgtggtcgaaaagatatcaataaaatcttgttttgatatgtcttgcgctaaattaattaaagacaaaattattattaatggagacattgcaacttatcttgagttaaagctagtaagtgctttgcgaaaaatttacgaaggtacgacacgaggtaaatttatgtctgataatatttgttttgacgcagaaaaaggagctttatttttgaatataaaaaataagggagaattaaaaaatgaatatttatacttctatgatgatcggtttaaaaacatcctttctttagaaaaaattaaagaagaattgcaaaattattacgatgctttgcgcgagaaaaaagccgttgaaattattgaaatcaaccgaattaacaatcttcgcgacgctctgtgtgccaatgctgtcggtattttaagctatttgcaaaaacggtattttggaatgatgtgttttgagaatcttaatcttgaaaataaaaataaacgtataagcgagtttgcgggctttttggcaagtagaattgaatggaaattactacaaaaatttcaaaccctttctttggttccgccgatttacaaacaagccatgacgctgcaaagcaatggaaaaataaatcaattggggattgtcgcgtatataaatacggaaggaacaagcagtgagtgtccgcattgtggaacaaaaaattctgataaatcggataaatggcacagtcatgcctataaatgtaaaaatacgcattgtaattttgacagtagtgataaaacaaagagaaggggacttgtcgggttggataattccgacagtgtcgccgcttataacatcgccaagcgtggtttacagaaggtagtagaagggacggtgtaa

SEQ ID NO: 270 - DNA, 3447 bp, unknown
  metagenome-derived sequence
  misc_feature (1)..(3447): Unk61 Cms1 native coding sequence; TGA encodes glycine
atgactatggtaaatctagaaagttttaaaaatttgtatgaagtgaggaaaagtgctaggtttaaaattgttcctaaaaaaattttcagacagaaggaagatagaggtagtatttataatacagaagacatagtaaaacagtataaaggtattataaaagatttagaaagcatattgtactatgaaaattttgttcctgaagccgaacctttgagtaataaattatgagatttatgtgatttttctaaatttgaatctgagttagaagaaaaccaagaaatatcttctttgaaaaataaagaaagttctgatttgattcgtataaaacatgcttggttacaaaaatattttacaaacgattggcacgaaaataaagactttataatttctaaaaggctggatcgcaagagaaatatagaaataaaaacgaagaattggacaactatttgaagtgtaaattttctaaaagaattttttgaaaatttttttacagatgctaataaatattttaatgtcatatcaaaactacttcaagtgcaagattttgaaaaaaatagacaatcagatataaaatttgcattacaaacaattcaatgaaaagatcatttatataaaatatatcaactttttgaatgaggatatattgaacataaaaatgataatacatcaatcaatgagttacaagaaaaattaaaagtattcaaaaataatgtaaataattatatagaaaattgcagaataaacgactcttttggacttcccttggaatatgttagcttaaattattatacaagaagaaagactcaaaaagattatgatgaagaaattcttaaaaaatcagagtccttaaaaaagaaatttgattgagatttatgagaattatattgaattagtaaagaatcagaaatttcagatttatacaacaatatgaaactgttcaaagcaaatcaaaagagtgcttttttacagttattgcagagtcagacacctttttcaaaactaaaaaataattttgagtatattgataataaaggagaaaggtactccgattacaaaatacaattgtttaatgatataacagaagaaaattataaagaaatgaaggatctaacttcaaaaattgaagaatcagacaataaacaaacaagaaaagcattgaaagagaaaagatgaaagtattttttattccattgtaaaaaatataacaatttctgtgattattataaaaaagtagctatggaattctgaaaaagaaaagcagaaatattgtctttagaaagagaaaaaattcttgccgaaagagaaagatgatatggatttttatcaagggacgctagtaataattattatataaatacttttgatatagaaaatacaaaaaatgcttatgattttttctcaaatcagtctcaaaagcaatgagagattacctattatattttaagttcaattactttaagagctttggaaaaattatgtttttcaaaatcttctaatttttataagtgaaatattgttcaaaaaatagatgaaaaattcttaaaaattcaagaagcaacaggaaataaaatttttaaaagtaaaagagaacttgaggaaggagaaaatttaattgaatttttggcagaggttctcagacttcaaaatacattatgaataaaatttaaatcagaaaaatcattagataagctcaagggctgtgaaaacatatcagattttgaaattttgttaaagaaagaaacatatattttggatgagtacaaaatatccaaagaagattttgaaaaagcacttgagaagtttaaatgaaattcttttcttattattgataaagactccgataatcataataaaaatagcgtattctctcagtggtggactagattttggaaaaaaaataatacagagaattatatattaagaatcaatccagagttggttatttcatttagaaaatgagacgaagaaaggtttaaaaataaaatatcatttcatagaaagaaaaatgatagttatatgctaacttttaatttttctcatttttctgataaatcttatattaattcagaatttatagatgacattcaaagaaaggagaatttagagagatttaataatttatacaataataatgtagatttagactacttttattgaattgataaatgaacaaatgagttagtaactttatgaatttataaaaaaaattgaggattgatggattcagtcaaaataagtgaaaaaataccagtctataaaattacaaataaatgattagctcattttgaatatatagtaaatgaaaaaacgtgaaaattagttattgataaagatacttgagaggagaaaaaaagatatctatcaaaaaatgtttcatattttataaaagatttagaaaataaagaactatttgaacagttagaaataagttcttgtttatgagatttaacatatgcaaaaattattaaatgaaatattattctaaatgctgatatttttaccactgtcaatttatacaaggtaacagctaaaagatttcttaatgatgcgacttttagagggaagataaaaaataatactgtattatttgatgatgaaaataaaagtttttattttgaatacgagaatagatgaaagctacaaaaacagaatatattttattggaaggatgattttgattatttgccatgtgatgatatatttcagaatctaaaagaagaagtagaaaatgaacttaatatgtatttaaccagtatttcaaatgaagaagatatctctatgcaaagagttaataattataaaaatgccatctctgcaaatattgttggaataattactgagttacaaaaacattttaatggatatatttgttatgaaacactggatgcaggacaaatagaacaaaaatgattgaatacttttatatgaaatactcttaacgaaaagatttataataaattacaattaagtttagaagtcccgccaattttaaagaaatttagaactgatatttgaacgaaagaaataattcaacattgaaaaattatttatgttaacgaaaaaaatacttcttcagcttgtccaatttgtaacgagcaattattaaattgaaatctatctgataagaaggatgatgaagtttttaaattatgatgacatttaagtgattttgaaaataatatgaaacatttaacagatctagactatcaggaatggttaaaaaataaaagttttaaaaaagctaacactaataaaaaatgagaaatagaaaaaaataaatacaattcttgaactataaattgaaaatcttgtgattattatattggaaatgaaaattatccagaatttgaatttataaaatcatgagacgatcttgctacctacaacatcgccaaaaaagctaaggaatatttagaatctttgtcaaaaaaagaagactcagaataa

SEQ ID NO: 271 - DNA, 3372 bp, unknown
  metagenome-derived sequence
  misc_feature (1)..(3372): Unk62 Cms1 native coding sequence; TGA encodes glycine
atgttagaaaatttaactaacctttatgaagtgatcaagacattaaaatttgagctcaagccaagcaagtttactttaaaaagatgtgattttgatagggcttttgaagctgatcctcatgctttatttgaaaaattaaggtcagtacataggtttcaagaacaaatcctcgatttattatgaaaaacatcttctaaaaaaattgtaattcataaaaatttaataaaactgattgatgctgattatttttatcaactaaaatcaaaagctattagctcaaataatactatagctgttcttagtcaggatttccaagaagagtttttcaattatatcaaagaaaaatttaatagattacattcaactaattacagtcttgattatttactttgggcagattatttagaaaatcctacaactatagataaaaaacctacgaaatcagaaatagcttttgctacaaaaaggtatgttcatgcaattgaaaaagtggaagaaattctatctaatttaatttataaaacatgaaatattgatagagaaattgaaagtttgctagctaattattataataatcaagatttgaaaccacttttaaaagtagcaaagagctatctacaatcatatagtccaacaagctgatttcaggtttcaaaatttggatttaatgcaaaagcaatccaaaagaaagttgatgtagaaaaaatggagcaagagatttgatctttagaaaagaaaatgcttgatttggaggagaaaaagattatagccacgcaaatttttgatgattatgccaaaaaatttgtacaagagaagataaaatctgatcctaaattgttggctcttagagagaatcaaacagctagtcttgatgaaataaaaagagcaaaagaatatctaaaatatttgaaagagtgagattttgattaccaaaaaattttaaaagaaagaagtaaggcaagaaaggaaaaaagggattctatgattaaatttacttgagatagagagtattgtgaactaaaattggcaaaaactgatgctagtgtggtatacggtagagcaaaacaagctttttttgccaaacaacaagaactatattctcaacaggctttgacccattatgcgagaatcttgagaagtgaatgaaattattttgtggcaatgatagatagagatgatgtatcttttttagagcgtttatgaactaatgataaagtaaataatgaaaaatttgaaattttaagatatgcttcattgacagcaagagctgtagaaaagttaatttttgaaaagaatgctttaaaatttaatatatatgacaaagagtataaagaatgtaaaatgatccgagaaaaaagatcctataaagagaaatgaaatgaagattctcgctcaaagaatgaaaaacaaaaggaaaatttaaaaaaattagtcttatttttaaatagtgctattgaacaactaaataaaaaacttgaatgatgaatctttgattggaaaccattcctaatttgaaacgattttgataatttctctgaatttcaaaaatatattacagaaaactgctatattgcgagacgagaagctattgataagcaaacaatttacgatttggatcaaaaatgaaaactaaatttttaccagatctttaataaagatttttcagttgatccttattgtgcaaccactgaaagagacagaagtagtacaataaaaaacataaatttacaatctaaaaaaaatctttttactttatattggcaatctttatatacagaaaacagttgaacgattagattaaatccagagtcaaatctttattttcgtccatctagagtccgtacggaaattgatttatgtaatgattgcgaagcaagtaaattgagatatagacaaaacaagattatcggagattttcaattggtattttatccgactaaagaacttccttttgatcaattacagcaaaagattttaaaaaattcagaaaaatcctatgcgatagggatagatcttggagaaaatagtttggctacgatctgtcttgttgacaatgaaaagaaggttgttttagatggaaataataaaccgatcatcaaagacttatctatgatcaacaataaatgagattttgtagaagtggaagactgttttattgattgaaaaccgtatgaaaggaagcaaaaattattgatttgagggacagaaaccaagccttatatgttaggacgacattttcctaaacatttgcaaaataaggtaattgcagaaatgtcgcaagatatgctttttgaagtattgcaaatattggaaagtttggctccagaaaagctttgaattgttgataagcaatgaaataaagtatttgattataattacgcatttgaacatttaaaggctataaacaagattagatatcatctacaagtatttaaccatactaatgatgaaatgagaattctagaaaaagatttattagcaagtattaaaatcaggtgatgatttgtttgaaagattgtttcatatattactcaaatggcaaaaaaatataatgctattatcgtattcgagaatttagatcaagaaattggtagaatcaaatgaagatatcttttttcagaacagtcttatgctaaagtttctcctaaagaagagagaatgtataaaggaatctctccttatcaattgatgcaggataaaattatccaaaaatgcaattatctcttaacaaagcaagaaatcaaaggttgaatgcaaatttctcctagactaaaaagacaagaagatattaagcaattaactttactaaaagataagaattgtgcttggggaaaaatcatttttgtcaatgaggaagattcttctaaagaatgccctaattgtggctttgtcccttgaaaatattcaagtaatatcaatattaaagacgattgaattgagcttatggcaaacaaaaaggataaaaaagttttctcttttgcagaaaatcagcttttgtctgaaagacgagaggcttatcaaaagatttcagatattgataaaaagaaagctcttttaattgaaactagagtatgaaagacatttttaaaatcttatatggatattcaaggagatccaatgatttgtgtgaactgcggatatgatacgagaaaaactaagcgagtagaaaaatataacttaaaaagttgtgatgaaatagcggcatacatcatagcaaaaagatgattggaatttatggaaaataaatgatatgagactcaagaagtatctatttcagttggatgagattcttacaacaagccatctgatggagaacaagatgattcttgtgcttcaggagttaaactttcatgaaatatttctttttcataa

SEQ ID NO: 272 - DNA, 2721 bp, unknown; identical to SEQ ID NO: 82
  metagenome-derived sequence
  misc_feature (1)..(2721): Unk63 Cms1 native coding sequence; TGA encodes glycine

SEQ ID NO: 273 - DNA, 2733 bp, unknown
  metagenome-derived sequence
  misc_feature (1)..(2733): Unk64 Cms1 native coding sequence; TGA encodes glycine
atggagaaaaattataagagtgaaatcaatttatcttatgaagacattctaaataaatttaatttattatgaagagctattgatatcgcaaatgattttaaaaattccaataatcaaaataacttttctcttgatgaatatcctataaagttagcctttgattatgcttgggaaaatacagcaagaagcttgaaaagaactatacctttccccaaagaggtatgtaaacaatttttaaaagataattttgatgttgatatcgataatgcagattttaaattatatgccaatcttttattcatagcggataacctagcaactatagaatataataacccaaataatgaagtagaacttataaatgaaataaaacaagcatttgaatgcattagctttccttttgataaagaagtatataaatgacataaagaagctattttggaattattagataaagaaaaatctcaaagagactattccactatattaaaagcaaaacaagaattgtgattattgagatgatgattgaaaaataagattaaaaaatacagagatttaacacagagattaatagacaaaaagaattcacatttttgaatcgcgagttttgtgggaaaaacacttgctacaataagagatggtttaaaggaagaaaatgaactaaataaaattagtgattactgagtaattattgaggatagtaatcaagataaatatctacttactctagagctaaatgggaaagatataagagatagaattagaaatagcctatgaaactgagaatataagacatatgaagtaaattcctttacttcaaaagcattaaataaatttatcaaaaatcctttatcagaagacgcaaaaaaatttcatgggaaatataaggatgaatatagtttttgatatgaaaataaagattgagatttcacttataaaataacaaaagtttcaaaatatgatgaacaaggaaaatggacatgataccaggaaagttttttaagtcatataaaaaagtgtttaattgactctgagatttcaagagaacaaaattgggaagcctttggttggaattttgctggttgtaatacttatgaagagatagaaaaagaagttgattctaaatgatatcagttgactgaaaaccttatttcaatggggaatttaaaaagcttggtaaaagatgaaggttgcttgttatttcctattattaatcaagatatttcaagtcaaaaacaagaaaataaaaacatttttactttagaccttgaaaaggtatttgagtgaaaagaatgtaggattcatccagaattttctatcttttatagaaggccaatagaagaacacaagaaggagaataaatcatgaatcataaatcgttttggaaggttacaattattggcaaatcttggtatagaatttgttccaagaaatccttcttttaaaacaaagaaagaacaaaatagaattgcgattgatcaaaagaagcaaaatcagttagtgcaagagtttaaccaaaaaaaagtaaatacatattttgaaggattagataattattatatttttgggatagatagatgaatcaaacaactagcaactttgtgtgttactgataaagattgagttatacaagattttgatatttatacaaagcactttaatagtgaaagtaaaaaatgggaatacaaatttcatagaaaagattgaatattagatttaactaaccttaagattgagtctgatagaagttgaaataaatacatagtagatatatctttatttcaagctaaagatgaagattgaaatcctacaggtacaaataaacaaaatatccaacttaagcaacttgcatatatcagaaaattacaatatcaaatgtctgcaaatgaagaatgagttttaaattttttgggaaaatataagaacaaagaagaaagagaacaaaatatggaagaactaattactccatataaagaatgaaaaaattttgcagatttaccaatggatatttttcaagaaatgtttgaaaattattatagattaaaaactgatcaaaatttgtctgaatctgagaagaaaaatcttatgaagatcactacagagcttgatgcaagtgaaagcttgaaaaaatgagtagtcgcaaatatgataggagtgatttattatttgatgaaaaaatatgaatataaagtgaagatttctcttgaaaatctttcaaatgcttggcttttttcaaaagacggactttcttgagatgttgtgctaaatacgaaaaatgatgaaacaatggatttaaagaaacaagataatctagcgcttgcttgagtttgaacatatcatttctttgagatgcaattattgaataagttatttaaaatttctaccgaagaatgagttttgcatttagtcccaagtttttgaagtgtaaaaaattatatagagattatgaagataaaaggaaaatatgtatacaaacaatttggcattgtttatttcgttgatccaagaaatacaagtaaaaaatgtcctgtttgttgaaagtgatgaaaaaaatatatctcaagagttgacaatgttgtaacatgtaagaattgttgatttgatacatcatcagacaattccatccttataaataattataaaaaacaatgtaggttttttcttcacaaaaaaactagactttttagtctagtttttcaaatatatcatgataatgttccaaagtgtaactag

SEQ ID NO: 274 - DNA, 3312 bp, unknown
  metagenome-derived sequence
  misc_feature (1)..(3312): Unk65 Cms1 native coding sequence
atggaaaaatatcaaattacgaagagtatttcttttcgattgaataaagtaaaagctcccatattagaagagcaagttgaaaaaatcggagatgtgaaagaagcagaagcaagtctattgaggcttttttcagtgggacaggatttagcaggactcttaaaacagtatatttataaagacaatcagaaacttaaaagctctgtaacggtgcattttagatggctcagagattatacaaaagataaattttataattggaaaactgaaagcagaagagatttttctagagaaaagagatttaaactttcagaagttgattatctgaaagaagtattcgagcattttatttctgattgggataccattattcaaaatttgggttcagaaatttctcgcaaacaagaagcactttcacgcaaagcggagatagggaagattattaaaagaattggaactagaaatgtatttctttttttcgagaatctcataattgaaagcaaagataaaaatgaaattcatttagaagcccagctaaatgagaaaataaaagtatttaaagaaaacttaatcaaagcagaacaatgggcgttacccgcacaatcggctggaatagaattagcaaaagcaagttttaattattatacaatcaataaaaagccaaaggattttgaattagaaaaaaggaatctagaaaaacaattacataattatgacgagagatttatgaaagacattgcgcaaagagagaacaagctttttggcgagctaagaattatagaaaaagatgatgctacgaatatgtatagatttctttatgaactgattcaaaatggcgaaggaaaacaagtattagagaaaactgataaaggtttaacggttgatctcgattcactttacaaaaatttgaaggtatttagagcagagcaaaaaaagtcattccaagaggcagtttctaaaggatcatcatacgatgacactgcaaaaataaatattctatttagctcagtagatcaaaagaataatgaaaagaatttgaaagccttcaataagtataaagaattcacagacaccatacaaaaattggctgaccagaagaataaagtagaaagggattctctaaattctcaaaaattacaagaagaaattagtaggatcagacaatataggggaaaattattatttcaaggacctagcaaaagaggagaaccggaagaacgattcgataagtatttaaaattttgcaaagtctataaagatatcgcactcaaacgcggtcgcttggttgcccgactcaagggaattgaaaaagaaaaaatagattcgcaaagattgaaatattggacttttatagtagaaaaagacaagcaacatcaattggttctgattccaaaatcacaatcacaaaaagtttatcaaaaaatttcatcctatgaaagcttgggagctggatcttcggacatctattatttcgaatctttaacctatcgagcattgaaaaaattatgcttcggagtaaatggaaatacattcattccagaaattagtgaagaactaagaaaagcagggaaatggaattacgaagaaagagatttcggagagcatatatttaaaataagaagtggtgttgaagaaataagagatgaaaaaagattaatcgctttttacaaagatgtgcttggaacagattatataagaaaaaatagagagggaggaaaaatagtattaccttcttcttttgatgaagaagttttgattcctgaattctctacagagcaagaatttcacgcagcattggaaaaatgctgttatcttcgaaagaaaaaaattccaaaggatgatattgaaaagatattttctgaatgtagtgcgcaaatctttactattactagttatgatttagaaaaacaaaacaaaacaaatttaaaggcacatactaaactctggttcgatttttggacgggagaaaatgaagcacaaagatttcctttaagactcaatcctgaaattagaattctatggagagaaccaaaagctacaagagttgaaaaatatggcaaagattcaaaactgtttgatcccaaaaaaagaaaccgctacttacatccgcaatttacattgactacatcttttattgagaatgctctgcatcctgaaatcaattatcgtttcttagacgcaaagcagaagaaagaaaatgtaaagaaatttaacatggatatatatgcaaagttaaagccgttgcccaaagcttggtattacggcattgatacgggaatagttgaattagccagtttatgtttgattcaaaaaaacggtataccccaaacttttgaagttcttaatctaaaagaagataagatgaattatgacaagacaggttatctaaaagatggaacaaaaaagaaatataaagcgattcaaaatctttcctattttttaaatgaagacctttataaaagaacctttcaagatgaaagttttttggatacatttgcagagatatttgaaaaaaaagaggtgtcagcacttgatttaagtgtatcgaaaatcatttctggacatatagtaatgaatggagatattacggctagattaaatgtagcgttagcaaatgcacggagaaaaattgtagatgctcttattaaaaatccttccgttcaactgagcgaacaggattataatattaaagttggcgatgaaattattttcaaaggaagaatagaattcaatgcaattaaatcatgggaagatattcaagcaataattcattcatcctttgagaaagataaagagaatttagccagagttcaagaagatataaataagtatcgtcaagtaattgcagcaaatgttacaggagtaatccactttctttataaaaaatttcccggacttattacaattgaatacctagatcaaagtgaggtagaatcacatcgaaaagattttgaagggataatagataatccggtagaaagagctttgtatagaaaattccagacagaggggctgactccaccagttagtgaattgtggagtatcaagaataaaaatgaacagattggtatcatctattttgcagatcctaaagacggaaagaagggagcgcatggtatacgatgtccaaaatgtggggaaaaagcatatcctcgatcagaagatgatggatacaaaaaagataagaataataaaatcttccaatgcaaacaatgcggctttcacaacctcaacaattcaatgggcttattgggattagactctaacgacaaagtcgcggcttacaacatcgctaaaagaggattggaaatttaa

SEQ ID NO: 275 - DNA, 3816 bp, unknown
  metagenome-derived sequence
  misc_feature (1)..(3816): Unk66 Cms1 native coding sequence
atgttagaaagttttaaagatttatatgaggtgaggaagacagaaagaatctgacttactcagccaaataaaaaatgagaaaaaatatctcacttagagcttaatgaactagtaaaaacatcacttgaaagaataaaaagtgatatagacaaagatgataattctataataaaaaatgaaaaaaatttaattgagaattcaagacaatttgtaaatgaattaaatgttcagttttgaacttggaaaaatatctataaaagatatgacttaatttcagtaaacaaagattattatagaatactagctaggaaagcaaaatttgatgctttttggaaagaaggacgcacaaaatacccaaaagctaatcaaattactttatcatcattacaaaaatgaggaagaaaggaaaagataatagaatattggaaagaaataattgaaagaagttattatttaataagtatttttacacaaaagctagatcaatatgaaaatgcagtctcaaatccagaaaaattatcccacacaaaacctgattttacagattttagaaaaatatttctacaacttctaaaagtaagtgaagactatttaaagcccttatttgataaatcaattaattttaaaacttgaaaaaaattagaatcagaagaagatataaaagaaataaatttatttatatctgaggaaaataacaaaaacatctattcattactaaaattatgaagtgatataagagaatattttgaagaaaattgagcacaagtaccatataaaaaggtaagtttaaattactatacagcagtacaaaagccaaataactttgaatgagaaattaaaaaagctatagaggatttatggatagttgagttcttgaataaaagtgatagtcaaattatcaattatcttcatcaaggatcaaaacagaaaaaaaaattattacttacttcaaaacatccttatcctattgagttattacagttatttaaagtaaaacccattcctttttcagtaaagtataatttggcaaaatttatggagaaaaattataagaatgaaatcaatttatcttatgaagacattctaaataaatttaatttattatgaagagctattgatatcgcaaatgattttaaaaattccaataatcaaaataacttttctcttgatgaataccctgtcaagttagcctttgattatgcttgggaaaatacagcaagaagtttaaaaagaactatacctttcccaaaagaggtatgtaaacaatttttaaaagataattttgatgttgatatcgataatgcagattttaaattatatgccaatcttttattcatagcggataacctagcaactatagaatataataacccaaataatgaagtagaacttataaatgaaataaaacaagcatttgaatgcattagctttccttttgataaagaagtatataaatgacataaagaagctattttggaattattagataaagaaaaatctcaaagagactattccactatattaaaagcaaaacaagaattgtgattattgagatgatgactgaaaaataagattaaaaaatacagagatttaacacagagattaatagacaaaaagaattcacatttttgaatcgcgagttttgtgggaaaaacacttgctacaataagagatggtttaaaggaagaaaatgaactaaataaaattagtgattactgagtaattattgaggatagtaatcaagataaatatctacttactctagaactaaatgggaaagatataagagatagaattagaaatagcctatgaaactgagaatataagacatatgaagtaaattcctttacttcaaaagcattaaataaatttatcaaaaatcctttatcagaagacgcaaaaaaatttcatgggaaatataaggatgaatatagtttttgatatgaaaataaagattgagatttcacttataaaataacaaaagtttcaaaatatgatgaacaaggaaaatggacatgataccaggaaagttttttaagtcatataaaaaagtgtttaattgactctgagatttcaagagaacaaaattgggaagcctttggttggaattttgctggttgtaatacttatgaagagatagaaaaagaaattgattctaaatgatatcagttgactgaaaactctattttaaaagagactttaggaaaattgctgaaagatgaaggttgttcgttatttcctattattaatcaagatatttcaagtcaaaaacaagaaaataaaaacatttttactttagaccttgaaaaggtatttgagtgaaaagaatgtaggattcatccagaattttctatcttttatagaaggccaatagaagaacacaagaaggagaataaatcatgaatcataaatcgttttggaaggttacaattattggcaaatcttggtatagaatttattccaagaaattcttcttttaaaacaaaaaaagaacaaaatagaattgcgattgatcaaaagaaacaaaatcagttagtccaagagtttaaccaggaaaaagtaaatacatattttgaaggattagataattattatatttttgggatagatagatgaatcaaacaattggcaacattatgtgttactgataaagattgagttatacagtcctttgatatttacacaaaattttttgattctaaagaaaaaatttggaaatatacaaaaactagaacggaaggtgttcttgatttgacaaatcttaagatcgaatctgataaaaattgaaatacttatatagttgatatttcgttatttgatgcaaaggatgaagattgaaatcctacaggtacaaataaacaaaatattcaacttaagcaactggcatatatcagaaaattacaatatcaaatgtctgcaaatgaagaatgagttttaacttttttgggaaaatataagaacaaagaggaaagagaacaaaatatgaaaggactaattactccatataaagaatgaaaaaattttgcagatttaccaatggatatttttcaagaaatgtttgaaaattattatagattaaaaactgatcaaaatttgtctgaatctgagaagaaaaatcttatgaagatcactacagagcttgatgcaagtgaaagcttgaaaaaatgagtagtcgcaaatatgataggagtgatttattatttgatgaaaaaatatgaatataaagtgaagatttctcttgaagatctttcaaatgcttggtttttttcaaaagacggactttcttgagatgttgtgctaaatacgaaaaatgatgaaacaatggatttaaagaaacaagataatctagcgcttgcttgagtttgaacatatcatttctttgagatgcaattattgaagaagttatttaaaatttctaccgaagaatgagttttgcatttagtcccaagtttttgaagtgtaaaaaattatatagagattatgaagataaaaggaaaatatgtatacaaacaatttggcattgtttatttcgttgatccaagaaatacaagtagaaaatgtcctgtttgttgaaagtgatgaaaaaaatatatctcaagagttgacaatgttgtaacatgtaagaattgttgatttgatacatcatcagacaattccatccttataaataattatgaaaaacaatgaaaaaaacttcattttataaaaaattgagatgataatggtgcatataatatttgagagaagataagagaacttccaaaaaaatcagatgtaaagaatacctcgatttcatgaaatatttctttttcatag

SEQ ID NO: 276 - DNA, 3630 bp, unknown; identical to SEQ ID NO: 100
  metagenome-derived sequence
  misc_feature (1)..(3630): Unk67 Cms1 native coding sequence; TGA encodes glycine

SEQ ID NO: 277 - DNA, 3807 bp, unknown
  metagenome-derived sequence
  misc_feature (1)..(3807): Unk68 Cms1 native coding sequence; TGA encodes glycine
atgattaatctagaaagttttaaaaacttgtatgaagtgaggaaaacagtcagattttgattaaatcaacctagaaagaaaagtgatattaataaaacgcattgactattaaaagatttggttgagatttcttttgagagcgaaaaaaaactaattaataatgaaaataatcacgtactaattgatacagagaaagttcttatagagaaattacagcaatatgtaaattgactagaaatacaactaaaaaactggaaatgaacatatcaaagatatgatttaatagctataaataaagactactataaaatattggcaagaaaagcaaaatttgatgctatgtgggagattactaaatttgataaaaaatcaaataaatatataaaagttaaacaaccccaagcaagtcaaatttctttatcatcattaaagatttgaaatagaagtgatagtattattcaatattggtgagagataattgagaaaacagattatttacttaatatttttaaacctaaattagaacaatacgagagggctattaatgatgctaatagtgctcatattaaacctgatagtattgactttagaaaaacctttttacaacttttgaaactaactaaggaatttttacaacctttattggatagatcaattattttcgagctttcaaagaagaaagtttctcaagaaattgaaaagatttctgagtttgcttgagaaaaaaataatacaaaaatttataatgtattgaaaaattgagaagaacttagacaatattttgaagcaaattgatctcaagttccatactgaagagtaagcttaaattaccatacagcagtacaaaaaccaaataattttgaacaagaaattaaaaaagctatagaggatttatgaatagttgagttcttgaataaaagtgaacaggaaattacaagctatttacatcaagattcaaaacaaaaaatacaattattacttacttcaaaacatccttatcctattgagttattacagttatttaaagtaaaacctattcctttttcagtaaagtataatttggcaaagttcattgagaaaaattataagaatgaaatcagtttatcttacgaagagattttagataaattgaatttgttatgaagagctattgatatcgcaaatgattttaaaaattccaataatcaaaataacttttctcttgatgaataccctgtcaagttagcctttgattatgcttgggaaaatacagcaagaagtttaaaaagaactatacctttccccaaagaggtatgtaaacaatttttaaaagataattttgatgttgatgtcgataatgcagattttaaattatatgccaatcttttattcatagcggataatctagcaactattgaatacaataatccaaataatgaagcagaacttataaatgagataaaacaagcatttgactctatagacttttcttttgataaagaaagatattgatgatataaaaatgatgttttagtattgctaaataaggcaaaatctcaaagagactattccactatattaaaagcaaaacaagaattgtgattattgagatgatgactgaaaaataagattaaaaaatacagagatttaacacagagattaatagacaaaaaggattcacatttttgaatcgcgagttttgtaggaaaaacacttgctaaaataagagatcgactcaaggaagaaaatgaactcaataaaatttctcattacggagtaattcttgaagataaaaatcaagataaataccttcttatatcacaacttgatggaaaagatacaagagaaaaaatatctcaaaaacttggcaatggagatataaaggtgtatcaagtaaattcttttacttcaaaagcattaaataaatttatcaaaaattcttgatcggaagatgcaaaaaaatttcactgagattttagatataaacataaagaagtttcaatatatgacgaacaaggaaaatggatatgatatcaggaagaatttttaaatcatataaaaaagtgtttaattgattctgatatttcaagagaacaaaattggaaagcctttggttggaatttttcttgttgtaatacttatgaagagatagaaaaagaaattgattctaaatgatatcagttgactgaaaactctattttaaaagagactttaggaaaattggtgaaagatgaaggttgcttgttagttcctattattaaccaagatatttcaagtcaaaaacaagaaaataaaaatatttttactttagattttgaaaaggtatttgagtgaagagaatatagaattcatccagaattttctatcttttatagaaagcccatggaagaacacaagaaggagaatagatcatgaatcataaatcgttttggaagagtacaattattggcaaatcttggtatagaatttcttccaagaaactcttcttttaaaacaaaaaaagaacaaaatagagttgcgattgatcaaaagaaagaaaacaagttagtgcgagagtttaatcaagaaaaagtaaacacatattttgaaggattagataattattatatttttgggatagatagatgaatcaaacaattggcaactttatgtgttactgataaaggttgagttattcaggattttgatatttatacaaagcactttaatagtggaagtaaaagatgggaatacaaatttcatagaaaagattgaatattagatttaactaaccttaagattgagtctgatagaagttgaaataaatatatagtagatatatctttatttcaggctaaagatgaagattgaaatcctacaggtacaaataaacaaaatattcaacttaagcaacttgcatatatcagaaaattacaatatcaaatgtctgcaaatgaagaatgagttttaacttttttgggaaaatataagaacaaagaggaaagggaacaaaatatgaaagaactaattactccatataaagaatgaaaaaattttgcagatttgccaatggatatttttcaagaaatgtttgaaaattattatagattaaaaactgatcaaaatttgtctgaatctgagaagaaaaatcttatgaagattactacagagcttgatgcaagtgaaagtttgaaaaaatgagtagtcgcaaatatgataggagtgatttattgtttgatgaaaaaatatgaatataaagtgaagatttctcttgaagatctttcaaatgcttggtttttttcaaaagactgactttcttgaggtgttgtgctaaatacgaaaaatgatgaaacaatggatttaaaaaaacaagataatttagcacttgcttgagtttgaacctaccatttctttgagatgcaattgttgaagaagttatttaaaatttctaccgaagaatgaattttgcatttagtcccaagttttggaagtgtaaaaaattacacagagatttttaaggataaggggaaatatgtatataaacagtttggagttatttattttgttgatccaagaaatacaagtagaaaatgtcctgtttgttgaaagtgatgaaaaaaatatatctcaagaattgataatgttgtaacatgtaagaattgttgatttgatacatcatcagacaattctattcttataaaaaataataaaaaacagtgaaaaaaacttcattttataaaaaatggagatgataatggtgcatataatatttgagagaagataagagaacttccaaaaaaatcagatgtaaagaatacctcgatttcatgaaatatttctttttcatag

SEQ ID NO: 278 - DNA, 3567 bp, unknown
  metagenome-derived sequence
  misc_feature (1)..(3567): Unk69 Cms1 native coding sequence
atggcttcaatttgcacaggcgagagggaggttataaatatggaacaatacaaaatcactaaagcgattcgattcaaattagaaccaaaacatatctcgaaaatcaagtctgatgtaggtgctattgaactaaaaaataaatttaatctagcgtcattcatatcctctcttggtagttttatcagccaatttaatgaatatattttctatgaaagcaggaataacgaattcatcataaagggtaatctcaccgtcaagaatatctggctaaaacagtacgcaaagcaggagattgtaggattaaaacttaaaagagggcagactattggtgatattaagggcttatcggataaaataagaaaggcaagggatgaagttaatgatatctacttaaaactttgcgatgaaacatcaaaattgaatgaaagagcaaatagggcaaaaaagggactgctgattaagagattgaacgccagaaactcactgccgttattactttctcttatcgagaatacaactgacaaaaatgaaacaggcaatctgagtattcaactaaaacaattaggggcaaaattacaatctcaactggattctggtgtcaatatgtacctgcctgcacaatcaaatgggcttcctatcgcaaaggcaagtttcaattactacactattaataaaaaaccgatagattacgattatggccagaaaaagcaggaacaaatagataagctagaaattaatttagattctaactttgatagcttaattcctcagcatataaatatatccaataacctgaaacaagcaattaaatcagatatttcagatattgcaaaaaaaggaaaagacaatactcttctgcttggggatgctccttttgtaaatcatgattatgtttcgattcggcaaatactaaaaaatataaaagcagagcagaaaaaaatattttctgaatttatcccaagagatgattcgacatttaagaatttgaaaacaaattcaagactctatcttttcaacgatatttcaggagaagaatttaatgactataaacataaaacaagagtgattgaagagaaagcagaaaagaagaaccaatgcaataatgatgaactaaaaagagaattaaacagcgagttgcaaaatctcaaaaaagaacgtggttctttaatcaatgccgcagacagaaatactaaaggaaaattcaaaacatacaaggcgtttgctaacatttacggaaaagtcgcacgagatcatggtagaatattatcaacacttaaaggaatagaaaaagaacaagtagagtcacaacttcttaaatattgggctgttgttatagaagaaaacgggcaacatagtttggcccttatcccaaaaaagaatgcagaagaattcaagaaatggctggaaaataatgcttcgacaagttcggtatctcctattaaaacctactggtttgagtcactgactctgaggagcttgcgaaaactttgttttggatatatcgaaaatcaaacccattcaaatacattctatccagaactaaaaaaatctcctgaactcgaaaactacaaagatgataggggtgatttcattagaggtgagttttttttcgagggggatgaacaaagacttatcaaattctacaaagatgttttaggttcacaacacgctcagaaggttttaagctttccaaaacagcaagtcaaagacgacatcattgataagcagtttaacacattggatgagttccagattgctcttgagaaagtttgctatcgtcgctttgttctttgctcatctgatattaagctcaaactaaaagaatacgaagcagaaatatttgggattacttctctggatttaagaaatgctactaaaacaaacattaaaaatcacacccttatctggagaatgttttggaacaccaaaaatgaaagcaataattttgacatccgccttaatccagaaataacgctaacataccgctcgccaaattctggtaggatagaaaaatatggaaaagattcagaattgtatgatgagcgcaagaataaccgttacctgcacccccaatatacgctggttaccactatttctgaacatagcaatgccccgacaaaaataatgtcgttcatgacagatgatgagtttaaaacatcagttgacgcattcaaccagaaactcaaaaaagaagatgtgaaatttgcactaggtatagataatggtgaggcagaactttccacgcttggtatttatttgccagtatttaataaagattcaaactcagaaatttggaaactattcaaaaacgtaagtgagtatggctttaaatttctgactataaggaatttatcgtattctgagattgatgcaaatgagaggaaacgaaagattatccaaaatccatcatactttcttaataaaaatctgtatatgggaatattcggaagaactgagcaggattacgaccagatgcttgaaaagcaatttgaagaaaaatcattgcttagtttggatttaaccactgcaaaagtgattaacgggcatattattaccaatggtgatgtacctacattcttcaacctttggatgcgacacgctcaacgaaacgtctgggacatgaatgaccattcaaaatacaaaacagcgaagaaaataactataaagaataatgatgagctaacagaagctgagaaagccaagttcgctgaatacatatcagacgggaaaaaatatgaaccattaacagctaaagaaaaaagcaagtacttaaaatggatttttgaaaataggaatctcctacaatttacagatgaagaaaaaaagaaattcgataattgtcaaaggagaaaggacaacttttcaaaaaatattctttttgcggtttgtagcataggcacagatatttactcagttacagacgtttttgacgttcgacatattttcaagaagcgtaaaaacttcgatgtgctaaaatccgaagcggagattataaaagaaatagagtcatataacacaaacaaaagcatccggaaaattagcaacgaagaactagatttaaaaattaatcatttaaaacaatctgttgttgccaatgctgtcggtgtaatacattttctctataattattataaagaaaaaacaggtggtgaggggctaattgtaaaagaagggtttgacactaaaacggttgcagatggattagaaaaattcagtggcaatatttatcggattttagaaagaaaactttaccagaaattccaaaactatggattagtaccgccaattaagagtttgatggcagtgagagggggtggaataaaagataatggactatccaaaactatcagacttggcaatgtttgttttgtgagccaatcgaaaacaagcggaatctgcccgctttgtaattccaaaaaactagaccataacacaacttgtccggattgtcagtctgatttgattgaaattttccactcaaacaatggcgttgcaggttatactattgcaaagaggggatttgagaattttaataataactctaacaaaggtgtctctgaaaaatga

SEQ ID NO: 279 - DNA, 3390 bp, unknown
  metagenome-derived sequence
  misc_feature (1)..(3390): Unk70 Cms1 native coding sequence; TGA encodes glycine
atgatggaaaaattaacaaatttatatgaggttattaaaaccattaaatttgaactcaaacctagtgaatttactttaaaaagatgtagttttgatagtagttttgaatcagatcctcatgttctatttgaaaaattgaaaccaatacacaaacaacaaaaagagatattaaacatattatcaaatcttcctccacaaaaaatagtaatacataaaaatttaataaagttaatagactcagattatttttacagattaaaatctaaagcccttagtgcaaataacacattagtagttcttagtaaagaatttcaagaagaattttcaaattatatcaaagaaaaatttgatagattacattcaaccaactatagtctttcttacttactttgggcagatagcttagaaaaaccaagcaatacagacaaaaaacccacaaaatcagaaatagcttttgctgtcaaaaggtatgttcatgctgtccaaaaagtagaagaaattatttctaatataatttataaaacctgaaatacagataatgagttaaagacaatgttaaaatcatattatgataataaagatttatgatatatttttagcatcgcaaatagatatttacaatcatatagtccaacaagttgattccaggtttcaaaatttggttttaatgcaaaagcaattagaaaaaaagtagatgtagaaaaaatggaaaaagaaattagaatactagaaacaaaaatgcttgatttagaagacaaaaaagtaatagctacacagatttttgatgattataccaaaaaatttgtacaagaaaaaataaaaactgatcctaaattagtagcacttagagagaatcaaacagctagtcctaatgaaagaaaacaagcaaaagaatatttgaaaacattaaaggaatgagattttaattatcaaaaaattctaaaagaaagatcaaaagcaaaaaaagaacaaaaaaagtacgaacctaaatttacttgagataaagaatattgtgaacttaaactagcaaaaattgatgctagtgtcatatatggtagagcaaaatgagatttttttgcaaagcagcaagaactttattctcaacaagcattatcacattacgcaagacttgttagaaactgagaaaaatattttgtggtaatgatagatagggataatattaatgaattagataatttatgagacaatcagataaaaaacgatgattattttgagattttgagatactcttcactaacagctaaggcagtagagaaacttatttttgaaaaaaatgctctaaattttaatcgatatgataaagaatatagggattgtaaaaatatccgagaaaaaagaacttataaagagaaaggaagtgaagattctcgttcgataaccaatgatcaaaaaacaaaacttagaaagctagtttcttttttgaatgaagcaataactcaacttaataaaaaagttgaatgatgagtttttaattgggtaccatttaatatatccaatgagtttgacgactttgctgagtttagaaaatatgttactaaaacctgttatataacaaaatgggaaagtattagtaagcaaataatttatgatcttgataaaaaatgaattttagacttttatcagatttacaacaaggattttgctgtagatccatattttgctaaaacagaaagagataaaaatcgtattaaaaaagatataagtataatgggaaaacaaaatctttttacaatatactgggaatctttatttggagataattctagtaatattagattaaatccagaatcaaatctttatgttcgtcctgctaaagttgttgaagaaatttctgatcataatcccaattacgaaacaagtaaattgagatataaagaaaacaaaataatctgagattttcaacttgtattttatccaaccaaagagcttcctcttgataaattgcaaaagaaaatcttggatgaggtagataaatcatatgcaataggtattgatctttgagaaaatagcttagctaccatttgtcttattgataatgaaaaaagagttgttttggatgaagaaggtaagccgattatcaaagacctttctatgataaataacaaatgagactttgtggaattagatgattgttatattgattgacaaccttataaaagaaaacaaaaattattagtttgaggacaaggaaataaaccatacactttagggcgatacttccctgaaaaattccaaaaccaagttatctcaaaaatgtcaaaagaaacattaattgaagtgctaaaaatactggaagatatagcaccagaaaagctttgaatcgttgataatcattgaaacaaagtatttgattacaattatgcatttgaacacttaaaagcaactaataaaattagatatcatttacaagcatttgatcacactaatgaagagatggagattctagagaaagatttattggcaagtactaaaatcagaggatgatttgtttgaaaagtagtttcttatattactcaaatgtcaaaaaaatataatgctcttattgtatttgaaaatttagatcaagaaattggtcgtattagatgaatgacattattttcagaacaggaatatgaaaaagtatccgcaaaagaagaaagaatgtataaaggtatttcaccatatcaattgatacaagacaaaattatacaaaagtgtaattatcttttatctaaacaagataacacaaagtgaattcaaatttcacctagattaaaaagacaagaagatattaagcaactaactttattaaaagataaaaattgcgcatggtgaaaggttgtttttgttaatgaagaaaattcttctaaagaatgtcctgaatgttgatttatcccatgaaaatattcaagtaacataaatattcaagagaactgaattgaaattatggcaaacaaaaaagataaaaaacttttattatttgaaaacaatcctctgctaaatgaaagacgaattgcgtatcagagtataccagatacaaacgaattaaaaaagaaatctctgttgatagaaactagggttggaaagacaattttaactgaaacagatatgaaaattgtttgagatccaatgatttgtgtaaattgtggatatgacactagaaaagaagagtgggtcaaaaaatataacttaaaaagttgtgatgaaattgcagcatatattattgcaaaaaggtgattagaatttgttgaaaacaagtgatatgaaaaccaatcaatcgacaagcccagtcaaactaacacatttgaagagaataaaaaatcaaaaaactctgataatgaaaattcctcatatacaatgtctggtaatattaatttttcacactcttaa

SEQ ID NO: 280 - DNA, 3408 bp, unknown
  metagenome-derived sequence
  misc_feature (1)..(3408): Unk71 Cms1 native coding sequence; TGA encodes glycine
atgctttcaaaaaaaaacaaaaaatgaattaaacaacctcaagcaaatcaaatctctttatcatctttacatgataaaaaggatttaataataaattattgggagaataatatttcggaaagcgattttttaataaacatctttgaaccaaatttaaaaaaatatttagatgcacttgctaatcctgataaatattcacatacaaagcctgatttgatagactttagaaaaacatttctacaattattaaacgtaaacaaagaatatttgcaaccattatttgataaatctatcatatttgaaactggaaaaaagggagagtctaaatatataaatgagattaatgagtttgcttgaaatgaaaacaatttaaaaattaaagaattactagatttatgagaaaaaattagacaatattttgaatctaactgactacaagttccttattgaagagttagtttgaactattatacagcggtgcagaagccaaacaactttgatgatgaaataaaaaaatgaataaaagacctatgaattatagaatttttaagaaaagaggaaagtgaaatacaagtttatttaaatcaagaatcaaaagaaaaaataaaattattaaaagattccaaagaaccttattctattgagttaatacaactttttaaaccgaaagccattcctttttcagtaaaatacaatttagcaaaatatatagaaaaaaattacaaaaaggagcttggtttaaagtatgaagatattttgtataagtttgacttactttgaagatcttatgatatttgaaaagattattctgaatgcacagaaaagaacacattttcacttatgaaatatccaattaagttagcttttgattattcttgggaaaatttagcaagaagcttaaaaagggacatagattttccaaaagaaatttgcaaaaactttttaaaagataattttgatgtagatataaacaattctagttttaaattgtatgcggatttattatttattgctgaaaatttagcaaccatagaatacaataatccaagtaatgaaaaagagattatcgataacatcataaacacctttcaaatcataaattttgaaataaatggatataaaaagaaagactatgaaaatcataaaaccgcaattttgtctttattggaacaaggaaagaatgaaagagactttaagagcaatgtttttatcgaagcaaaacagaaactatgactcttgagatgatgacaaaaaaatctaattgcaaaatataaagaactaactgaaaaactagttgataaaaaggatattcacatctgaatagcaagttttatatgaagaaatttggcgaatataagagatggattaaaagaggaacatgaactaaataaaataactgactattgaataattgttgaggacaacaataatgacaaataccttttacttttaagacttgcttgaaaagataatagagagcaacttaaaagtaaattatgagatggcgagataaaagtgtatgagattaattcttttacttccaaggcattaaataaattcatcaaaaacccttgatgagaagatgcaaaaaaatttcattgaaattttaattataaatatagagatatttcaacttattctcatgaatgaaaatggattggttataaaccggattttattaaacatattaaagattcgctttgtaattctgaaatagcaaaagaacagaaacgggttgagtttggatgggattttgataagtgtaatacctatgaggaaattataaaagaaatagattcaaaatgatataatttaataaacaacactatctcaaaaaagaatctcgaatatttaattgaaaatgataattgtctattactccctcttataaatcaagatatttctagtaaaaaaacaataaataaaaacgcttttaccattgattttgaaagagccatagattgaaagtcatgatatagaattcaccctgaatttagtgtcttttatagaacacctatgcaagaatattcaaaagaaaataagttttgaattgttaatcgttttggaagattggaattgttggcaaatattggaatagaatatgtgccttcaaacaaaaattatactactaaaaaagaacagaataaaatctcattagataaagataaacaaaataatttaataaaagaattcaacgaagaaaaggtagataactattttgatagtttggataatttctatgtttttggaatagatagatgaatcaaacagttagctacactctgtgtaatggataaagcttgagttattcaggatttcgatatttatacaaaacatttcaataatactcagaaaaaatgggaatataaaaaaaatagaactgaatgaattttgaacttaacaaatttaaaagttgaatcagatcaaaactgaaccccatttctagtagatatttcattatttgaatcaaaaaatgaaaattgaaaaagttttggaactaataaacaaaatgagaaattaaaacagttggcttatgtaagaaaactacagtatcaaatgtcatttaataatgaatcagtattaaattttataaaaaaacatacgactcaagaggcaagggctgagaatatatgagaactgataactccatataaagaatgaaaacaatttgccgatttacctatagatacttttgaagaaatgtttgaaaattttcatcagctaaagacaaatgaaaacttatctgagttagaaaaacaaaatttaatgaagcttactactgaacttgatgcaagtgaagaattaaaaagaggagttgttgccaatatgattggggttatttgttatttaatgaaaaaatatcattataaagtaaagattgttcttgaaaacttatctaatgcttggtatttttctgaagattgattaacatgagatgctttgctaaattcaaaaaatgattgaataactgattttaaaaaacaagaaaatcttgcgcttgcttgagtatgaacttatcatttttttgaaacacaacttttgaaaaaaatatttaaaatatctattgaagaaaaaatccttcatttagttcccagtttttgaagtgtaaaaaattatacctatctaataaaaaataataaatcacaatatgtatttcgacaatttggtattgtttattttgtaagtccaaagaacactagcttcaaatgtcctatttgtctaaaatcaggaagagaatacataacaaggaacgataatataataacttgtaagagttgtggttttgtttcatgaaaagacaatgatgaaatattaaaaaaatataccaaaactcatctcaacatacattttatcaaaaattgagatgataatggggcgtatcatatatgaaaaaaactgctgaaatag

SEQ ID NO: 281 - DNA, 3000 bp, unknown
  metagenome-derived sequence
  misc_feature (1)..(3000): Unk72 Cms1 native coding sequence
atggtacctcaatatgaattcacaaaaacaataagatttactcttaacggtgaaaacactacttttttacttgataaagatataaattggcaaaaaacattgaatttcaatgattttcagataagttttaacgacctattgaatcaatttaaaaaaactgttttttatataaataacaatggtaaattggtggtaaaaaatagtttagaaattaaaaaatcatggttaagacaatatgcgcgtgatgaattttataagtttaacgaaaatcaacgaaaatataataaatttccagcaaaattatttcaacccattttcaatgattggtttaaaagaaataaatcattgttaaggcaattcgaaaagattaatcagatgccgcaagaaagccaaataaaaagatcagaaattttaacattattgcaggaaattaaaattgctgataattttctttttatcaaaaattttgtccagccgggaatagtaaatgataaaaaatccgattataatttagaagatttaaaagaaaaggtaaatcgatttgaggaattattaaataaagctatttttgctatggcaccggatttaagtcagggggcagaagtgtgccgagcgagtttaagctattatacagtaaacaaaatttctaaacgagattttgacaaagaattagaatacaaaaaacaagaattaaaaaagccatataataaagaattgaatcaacggcttttaaaaatggttggatttttagattatttaaaaagtgaatatcaaagtgatattcaaaatatttcaattcagaacttatatgaagcacttaaacaatttaaatcacagagaaaatcagagtttatgcaagctgtgcagcagggaaagcaagtaaaagagctgattaaagatttcccactgtttaatgcgcagaaagattcaatgcaaaaatttatttatgcttcaaaagataaacgaggaatatattttcaaaatcagtggggatttcctaattatgttaatttttgcaataacgtttttaaaccagtagcaataaaaatcggtaatttaaaagcacaaattagggctattgaacaagaaaaaatagaagctcgcttgctccaatattgggcgcatattcttaaaaaagataacaagtattatttattattgatacctaaagagaaaatgcaagaagtaaaaaaatttttgaatagtttaaacttcaaaaaagaaagagaatatacgctttatagttttaattcattaactttaagggcattaaaaaaacttattcgtaaaaatctcggtaaagagcaaatacgtcttcaaaatgataatactgcgatagcgttgtataaagaagtttttcaagataaacatcctaaattacagaatcttgattttagcggatttgaaaaagatatcaaaaaaatcatccaagaaaattataatagcgaagaagatttccgtttagagcttgaacgtgtagcttattgttgttttgagaaaaaaatgaaccaaaaagatatagatttaatgagaaataaatttagtgcgcttttattagaaatctccgcttacgattttgaaaggaatattatgggtgaaatgaaagaacattccaaaatttggcaaaaattttggaccgtggaaaataaaaataaaaattttcccgtgcggcttaatcctgaaattcgtattttttatcgcccgcaaagacagcaaggggaccccaaaaagcaaaaaaaccgttttgcaaaggatcattttggtgtagcatttacaataacccagaatgccgctcaaaaaaaattagatttagcgtttaccaaagaaaaagaaatatctgaagctgtcaaaaaatttaataaagaagttatcggcgaatttattaaagaaagagatgataatttatattattacggcattgatagaggccaacaggaattagcaactttatgcgtgatgcgattttctaaagagcaaggagaaataaagcttgccaatggcgaggtaaaaaaatttgatattcctattcctacaccaataaaattatatcgtattaaagaaaatcatttaaatggcacaaaggaaattattactgatcaaaacggcaaaaagaaaatagttagaatacttgaaaatccatcttattttattgacgaggaagaaaaatttgaagaaatcaaatctacttgttttgatttaaccacggcaaarcttattaaarayaaaatagttttraatggygatgtrcggacttatattgaacttaaaaaaactaatgggaagcggcaactttttgaaaaattgtcaaaaattgacgataatgcgaaaattgaattttgcgaggacgaaaatggaagaagatttcagataaagtcaaaatcaaccgaaagaaataaatatcaatatatcgttttttattcaccccaagatgaaaaaataatgtcgcgggaggcaatgcaaagagatttgcaagaatatcttgattatttgcgcactaacaatttagccaaagaagatattagtatagaaaagattaaccatttaagagatgcaattactgctaatatggtggggattattgcgtttttatttaaacaatatccgggaattattaaccttgaaaatttaactgaaacacattttgaaaaaaataatgaaaatatagagcgtcgtttagagtggagtttatataaaaaatttcaaaaatttagattagtgcttcctaaattacgtcaaacagtaattttacgtaaagaggacaaccaattaaatcagataggaattattcattttgtttcgccccaaaataccagctcctcttgtcctgtttgtggcaatgttgtaccaatggggaaaagagaaaaagataaatttaaatatcatatttttatttgcgataaatgtggttttaacacccaaaacccaaaatcaccttttgattttattaaaaattcagatgaggtggcggcatataatattgctaaaatccaacttaaataa

SEQ ID NO: 282 - DNA, 3378 bp, unknown
  metagenome-derived sequence
  misc_feature (1)..(3378): Unk73 Cms1 native coding sequence
atgaatgatgattttaaaaatttgtatgaggttcagaaaactattacttttgaactaaaaagcaaatatatagattatttttataaaaatggtcagtgtgtagaaaacaaaaattgtttcatcaattttgaaaaaacttcaaagttcatggaaaaaaattatttttccacttctcaaaataaaggaaattttgattgtgttttaaaatttcttgaaactactgataagatcgttaggtttgcagataattttgccactaattttagtaatgggaatattttagcaagaggatttgaagttaaaaaaaaattactagagaaatatgacagaatttctttttttgagttaaagaaaagaaagcaaataacagtaaaaagaaaaaacgtaaatacaggcaaaacatatgatcattttttgtattttagcgatagaatgaatttagaaaatttgtttgaaatgacaaatgatcaacatggaataaatttttgtcagtatttggaaaaaattttgaatagaataaagctctatcgagctaaaatggaaaataatttgactgtaaataatgataatgagttcacttttaataaaaacaaagttgttttttgctcagacgcaaaaatatattttgaggagtttaaaacgttacttgatatattttctcttattgaaagagataaaaaggtaggaatatacactatagataatgaagtaaatgaaacaaataaaataatagaagtatttgaatttattaataataaatattcaatcactctaaaaagcaacttaggatcaattatagaagttgtaaacaaagaggcaaaaaaaccgattatcctgacgtctttaaatccaagggtggtaaataaagattcaaagaaaacagaaagtgaatttcaaaatattcaagaatttgaaaaggaaattgaaatagaagaaatggaaatggatgcaatcaatattaaaaagtttgaatatgttgaattgctggaaaaaaaattgaaaaatagtctagacgagttgaaagttttaaaaacagatattcaatctctgattaataaaaaaaggagaaatgaaaaattgttaagcaatgaaattgcattatggaaagagtttcaatttgcgaaaactattttaaaatatatcaagttaaacggagtagttatttctaataaaaaaaatggtagaggtgaatatcaagatgttttcaattatagaaaatctggtgaaagattaaacaacccaaaaaatttattaggaataggacaacatccattatttcatctttttaaagaagagtatgataattataaaaatctttgtggtgaaaaatttaggaaagccaaatcgttgggggataaaaaatcgctttataacgcagtaagtcgtgaagtcctaagacaaaaagaaatgcagtatctaagttttttagcaaaagatagctatttttattatttagttctgattgataaagattttaacaaggatagaaaagttattgaccagattgggggttgcactggaaattggcaaatgctggattattatcaattaacttttaaagctctagaaaaattggcgttgttaggagaatcaacctttgatattaacaatcaagatataactaaagaagtaaaattaatttggcaaaattataaagagaaaaaatttaaggaatataggttatgcagagaagaaaaacaaggattgaatcggtttgagatagacaataaaaaagagtctttgcaaaaaaatgaattaaacaaactaattgactttattaaaaaagtaattaataaattgcctgattcaaaaaaatataattttcaatttaagtcgaccgaacagtataaaaatttggatgagtttaaaaaagaaatagatgaacagggatattttagtgaatggattagtattgataaagaaaaacttcttcaattggaaaaagaaacccagaaggaagtgttgatctttaagctacacaacaaagattttcgtaaagtggctatagatgaaaagagaaaacaaaatctttttacagaatattggctagacgctatgaggttagaaaaagaagttcgtataactcctgaaatagatatatttaaaaagaacaaagaagaaggcaatgtaccagaaaaaagagttttggaaacttctcaaaaagaagtaataagtagtgctagaatttatcaaaataaattatatggagcttttcgtttaaaattttatcctaatagaagctgttcttttgagaaagtaaatgaaaaaattaaatttaaagataatgtgtgttttcttggtatggatagaggcgaaaaatccttaatttcttggtgtttgatagataacactggaaagcttataaaaaatggggattggactaaatttgatgatgaaaaaaattctgataaaaaagcaaactacgctgagaaattaaaaatttacaaggagatcaaggaatgtattttgcaggattatgagagaattgcagaatgtattggctctgaagagaaacagaaattaatagacgaagtaaaaaagaaagaaaaagagctagaagcaaaaagtttattggcgactgagacaatcaaacagggttactgtggacatttaattaaagagataaataaagtattgcttgattatccgaatacatacattgttttagaagatcttgatatacaaggaaaatctgaaagtagggaatctgatattacaaataaaatggataatttagcaaaaacaatgggagcaactatttatcagacaatagaaaatgctttggtaaataagtttaagtattattccgtaaaaacagatttggaaaaatacgatgggcagcagttagttcccaatattgttaaagtagaagatttgagaatttgtgacaaagaaaatagagaatatggcaaacagaaatttattaagtcaaaagataaaataggaaatatattgtttatagatgaatatctaacttccaatgaatgtccaaattgcggatttaaccatgaaaagattaaaaatttgaattttaattttcaagaaagtgatcaaaattatattttagagaataatggagaaaaatatcttttctcaaaagattggtttaaggaggaaagagttaaaaatgttttgtatgataaaaaaattaagcaaatattttttccaagagcagttaaaaatccttttattaaaagctcaaaatccaaaaaagattttttttattgttctaaatgccaattttcgtcggagaataatttagtgaatctcggtttgataaacggcaattatcaaataaagactggagatgacttagcggcatatattattgccaagcgaggtcttactcttattctgaacaaaaaaaaggaaatttga

SEQ ID NO: 283 - DNA, 3297 bp, unknown
  metagenome-derived sequence
  misc_feature (1)..(3297): Unk74 Cms1 native coding sequence
atggaaaagtttaaaatcacaaaaacaattcgctttaaagcaataccacaaaaagcagaaagactacaggctcaagcagaggcattaatggataatcctaaagcggacattactgtgcttgtcattaagggttttgatttaattaatttatttgaggaattagtctataccaatgataaaaaagagtatttaagaaaaaatattactatccattttagatggttacgacaatatgtaaaaaatgaatggtacgattggaaacaagggaaaattgaaatagaaaatgataataacaaagcaaagcaaaagcaaccccaaaaatccaattcaccctttgctagcttattagccataagagataattttgatgatgctaaagaaaaagaacaaacagaccatactaacaaaacggcaaaaaacagtgaggataaaaaattaccattaggctctgtgccttttctaaaaaatgaacttcaaaatattagtagtagttggcgggagctattagatgaattaagaaaagcttttgaacgacctgaggaaaaccgtatgcgcagagctgatattgctaaatttttaggagggctttccacgagacaaatgctccctgcattaatcgaattcattaatgatttaaacgataaaaaatcagaagaacaaattaatgctttaaaaaaattagtacaagagtttaaagaactacttgaaacttgtcaaaatgcttatttatctgcacaaagttccggcataaatatagcaagggcaagctttaactattatacattaaataagaaagagaaaaattatacagaagaaaggcaaaaaatattaaacagcttgtcaaggtcattttttgaaaaaggaagagtaccccaaattattaaggatttaagcattgacgaaaccctttcaattggaaacctatatgagtttctaaaaaaatataaagcagagcaaaaacaacaatttcaagaagcagtaagccaaggtttaaagtttaatgaactgaaagaaaaatttccattatttgatacaattgaacctatctataaagactttgttgcaaaaaccaatgcaattactcaaaaaagtactgctttacaaaacagctctcaaaccaaagatcttaaagatgaaatcaataaactcaaaagagaacgggggcagatgtttcagaaaggaaaattcaggaaatataccgagttatgtgatgtttataaaaaagttgctcaaaataaaggaaaactaaaagcagctctgataggtatcgaaaaagaaaaattagattcccaaaaattgcaatactgggctttgattggaaggcaaaacaatcaatacaaactctatcttatccccaaagaaaaagtgcaggaagcctatgctgaaatatccaggcaaggcagaatagaaaacgaggtaagtacaccgctgtattattttgaatcgtttacttttagggctttaagaaaattatgttttggggtaaatggaaatacttttattcctgaaatcaaaaaggcatttcctgaattcaacacacctgactttggtgagcatactttcagaacgggaaatattgaacaagatgagcaaaacttaattcaattctatcaaaaagtgttagatactgattttgttcttagaaatttaaggttgcctcattctcaattgcaagaagtaatagatactaaatacaacagtcttcaagaatttaagattgccatagaaaaagtatgttacgccaaacaaacagtcttaaattcaagagtattaaggctattggaaaccgattttaaagcacaaattgttgagctaagcagtttagatttaaataaagaaaatcctacccatttaaaagcacatacccttttgtggaatagcttttggagtaaagaaaatgaagccaatcattttaccactagaataaatcctgagatcagcatctattggcgtgaagctaaagcctctcgaatagaaaagtatggaaaaggaacgccgctttatgatgagagaaagaaaaacaggtatttgcatcctcaatttacagtcgcatttactttcaatgaaaatgcacttagcaatgagttgaattttgcttttgagggttttgagaaaaagaaagaagctctaaacaatttcaaccagcaaataaaccaagagtttaaaaagggattagaaaatcaaattttaggtgcttttggtattgataccggagaagcagaattggcaaccattggattaacagataatggaaaaccttttcctacaaagcttattcggctaaaaacagaaaaattaaattttgaaaaacaaggcttttttaaagacggcacacccagagaaaaaccctatcgtgctattgacaatatgagttatttcttaaatcaagaattgtacgaaaaaacttttagagattatctttttcaagaaacttatacggaaatttttgaagaatttgaaaccactactattgacttaacttgtgccaaagtgatttgcggacatattgttttgaatggtgatttgcatatgcgtaccaagctcaatttattgaatgcaaaaaggcaaatacgacaagcacaaattcttaacccatctttagaaataaaatttgaagaagataaaatcttgatgcctgaaactgatgaagataaaaaagccatcacatcttggaaagccatctatcataccaatgaagagttggagcaaatacaacctataaaaacagtaaatgaaatgctactatcttatttaaaagagattaaagtagatgaatctattgaaatagaaagcatcaaccgataccgcaaagtagtggcgggaaatatggttggggttatagctcatttgtacaataaatatcctatccttattgctattgaaaatcttgcccaaggcactattgaaaaacatcgtttgcgttatcaaggtgtaatggacagacctttggagacagcactgtatcgtaaattccaatcgaaaggattaacgcctcctatatctgatgttgttgcaattagagaagcccttaccgaaaagaaaaataataaaaaaagtcagttgggtgtattacaatttgtagatgagcaactcaccagtaaaacctgccccaattgtggcaagaatgcctatgaaggtagtagaaaagaattgtacttaaaggagaagaaacaaggaattttttcttgtacttgtggctatcacaacatcaataatcctatgggcttgaacttacacagtaatgatgctgttgccgcatttaacattgccaaaagaggcattaaaaacattaaataa

SEQ ID NO: 284 - DNA, 3528 bp, unknown
  metagenome-derived sequence
  misc_feature (1)..(3528): Unk75 Cms1 native coding sequence; TGA encodes glycine
atgcaaaaatatgaagtaaaaaagactgttaggtttgagttgttaccaaaagaaaatacatcaaaaccagaaatcaataatcaagattatgaaaaaaatttaaatgaatttataaaatcgtatgaagaggctttacataaattgcaaaaaatattgtttaaagatgacacacttaatgaaaatttaaaaataaaattatcttttcttgctaattatacaaaatatgaattttacaagtatgatattgttttactgaaaaaatgaacaaataacaaagtatctctaagctctgaaaaactaaaatatttgtataatctacttaaatccaaaatagaagaaaatctaaacttacttaagaaacttaaggaattactaggcttaccattggaaaatcaatctagaaaaagtgaattaaatttttatttttcaaaacttactacaagagataattttgaattttttcaccaattagctaaaaatctatcttctgaaaagccacattttgcaaatgaaattgaaaaaattatttcaaaatttgaaaatattgaaaacaataatcttatggaaaaactaagcttagttttaaaatctacttgaacattttgagttgagatactaagagctagcttaaattactatacagtaaataaaaagccaaaagattatgataaaaaaattttagaaaaaaaagaagaatttaataagcttataggaaattttaaaaacaaaaatggtaaaaatatttttgacaataacatagctcaaaatagttgatttaatagttttttggaagattttgatgatagttatttttgaggaatcaaagattatcaatgaaataccaagaaagaaaaaaagtattattatctttctatccaaaatgcttatgatttgatgaaacaatacaaagcagaacaaaaacaagcttttatacaatttttggctcaatgaaaaaattttgaagatttacaaaatgaatttgaataccatattacaaaagaaaagacaaaaaatgttaaattaaaattgttttatggtataaaagaagaagatttcaatacaatgaaagaacttactaaacaaattgcagctcttgtaaaatttaaaaatcaattaaaacaaaaattagatgatgaaaagaaacaaaatttagaagctgaaatagacagttacaataaaacttatggaaccaattatgatttgtcagatgaaaatttgctagaaacaatttgaaaagatttggaaaaaatagccaaggaaagaggtaaattttttcaagaaaaattatcaaaatataaaaattttgctgaagaatacaaaaaagtagctcaaactctttgaagaataaaagcaaatattgtttctttggaaaaagaaaaaatagatgctaaaaaacttacacattgggctttgatattggaaaaagataatcctttacaagaaacttgtagaactgactctaagtataaagactgtaaactacgttatttattgtttattccaagggaaaaaattagatgagctagaaaatttatggataaactaaatccaaatccaaattgaaaatggactttgtataaatttgaatctttgactttaaaagccttaaaaaaactttgttttggtaaagaaaataatactttcagatgatgaatttatgaagaagctaaaaattacccagaacttttaaatgaaaaatgaaaattaaaagaactttatgaaataaagtctgatgaagaactaataaaattttatcaaaaggttttagatttagagtctactaaaagacaaataaaacttgaatattttgatgaaaatgaatttaacgaagaagttgtaaatgcagatattaaaactttgaaagaactagaagaaaagcttaaaaaaacagcttacattaaaaaacctataaaaattacagaaaatgtaaaaaataatttaattaaatacaacaactgacaatttttcaaagttacaagctatgatttacaaaaatatgaccctgaatttatcgaacagttagaatacaaagaccattttgatagaaaccatccagaatcttttacacaattatggtgggatttttggactgaagaaaatgaaaaaaattgataccctgtaagaatcaatccagagctaaaagttagttttattccaaagcaaaactgatttgataaatcaaggtatggaagagatagatttattgttgcttttaatatgtctataaatgctttagcttgagaactaaatttgtcattcaaagataaagatgaattaaaaaacttttttgaaaattttaaccaggaaatcaatacagagtttaaagataaaccttatttttattgatttgataaatgagaaaacgaaatcattacaatgggattatttaaacttgatgaaaatcaaaatgagcaaaaatgagtaaaaatcacagtatatgaacttaaaccggaatattttgaaaaagaaattgactgaaaagttgtttataaaaatttatcatattttcagtatgatggttatccacaattttacaaagaaaaagaagtttcttgcttaaacttatctatggcaaaactaattaactgaaaaatttatttaaatggtgatatggctactttcttaaaacttaaaaaaatagcaggaaaaagaaaaatctttgaaatagttgcaaacaaacaagctaaaagcaagcaaataatagaaaaagactgaaaattgtatattgattgaaatgaaggtaaaagagaaagtttatacttatttgatgagaaattatgaaatttggaaaataaggaaaaaatcaagcaagaattacaacaatatttggataagatttataatgatttaagcaaagaggaagtgagtatagaagaagtaaacaatttaagatgagctattgcttcaaatatggtttgaatagtaaatcatttattcaaaaaatatcctggctattttgtgtttgaagataaaactattgaagataacaaaaatcgttttgaaaaatacaatattacaatttgaactatttttgaaagaaaactattacaaaaatttacttataatggaaccgtgccaccaaattataaattattttttaccttaaaagatgaagaaaacctaaatcaaatttgaaattttatttacattccagaaacaaatacttcaaatgcctgccctgtttgtagtatatgaaactttttgaagaaaactagaaatggaaaaatagaagttgataatgaaaaaatttataaattatttggtcactgatattgaccagaatttgaaaatagtatgcatcatttatcaaatgaagaatacgaaaaacttaaaaatgaatgaatactaaaaggagatgacttaaagaaaaataaatatcaaccttgagaaataaactgaaaagaatgtgattatcatatgggtaaaaataactattgatttaactatttacactcttgagacgacctagccacatacaatatagctagatttggatttgactatttaaaaaatatccttaaaatctaa

SEQ ID NO: 285 - DNA, 3585 bp, unknown
  metagenome-derived sequence
  misc_feature (1)..(3585): Unk76 Cms1 native coding sequence; TGA encodes glycine
atggaaagttttaaaaatatttatgaggtgaggaaaagtattaggtttgagttgaagccttataatgttacaagagaaattttaaaaggtgataatgattattgaaatttagattcaaaaattaaacatataaaaaaatgagaatttgaagaaaattttaattggaatagattttgtctaaatggatatagtaattttttagaaaaatctaaatcttttttaacttttttagaagaagtaaatttagaaataaaaaaagaaaattggattaaatgaaaaaaagatatatattttgattttaaaagactaaaatgagtttttaaaaatattccttctctgaaaaaaatagaaaaatttgataacaattttaaagataaattatatgaaattgaaaaggaatataaaattctttttcatatatttcaaaagttagaaaataaagaaaaatgagaagctaatgaaaaaaaatcagaaatttcaaaatatttaagaaaaatatcatatttaaatagaaactttttaactatttttaagttttttgatgaatataaaacagataaatatttatttgataattataaaaaattattagatgaaacttttgaaaaaataaataattcaattatagcaagtaatgaaaatgaaaaaacaggttcttgtttttgaaagtttacttttaataaatattcactttttagaagagaaactgaaaatttaaaagataagtattataaaaataaaaaattattagaagaaaatgtaaaaaatatagtagaaactaaaaaaataaaagatgatagagaaaaaattatagaaataaaattagaaactattctagacttaaaacttgaaaaagaaaatgaaaaaattcaagaaagattagaaaaatttaattttgaaagaaatttagatgaagttatttctgaattagattatattaattgaaatatattaaataattacattcaaaattttattaaggattataaagaaaataaacaaacattaatttttaaaaatgaatcatctaataaatataataaatgaaaaattattttaaataataatgaatataatatttctgcattaagatgacaaacattagaatgatgagaatatttaactttattaaaaaaagactataaagatttaaataaagatgaaaaagaagaaaaaaggctagttgataagtttttaaatattattttaaaaaataaaaatataaataaagattttgatacaataaaaaattttagagataaattagctaaatatagatgaaagttaagacaaaatttttcagctagtgaaagagaattcataaatgaagcaatgattaaatattatgctaaaattttagaaaaagattgaaattattttttagctttaactgataaaaataatattttagataaaaatataaataatataaaaatagataaaaatataaaatgaaatattttttcaaatacttttaatatttataattattctcatctacatttttgagcattagaaaaattatgtttgatgtgagattgagatttaataaaaaatgattgactaattaaacagtggaataaatataaaaatcaaaaaaataatataaattgaagatgtgctatacatcaaagatattttgataaaaaatgtgaaaattgtaaaaatgataaagaaaaaaaagaaaaagagtttttttctagttttcaaagtcatataattaaaagtttatataaattaaaagagaataattgagaggattggactcaatatattacagaaattgaaaaattagaaactattgaagagatagtaaaatttattaattcaaatttttataaattagaaaaaaaagaaattaaaacagaggaaatttttgaattagcagaagaaaatgaagttgaattatttcaaatttatagtaaggattttaatatttttaatgaaaagtttttatcttgagaagaaaatttaagaattttaaaaagttgagagtgatatagagaagataagaaagaacattgagaagaaacaaaattaatatcaaacactaaaagaaaaaaagataaaaagaaaaatttatttactatttattttgaagaagtatttaaaaatagagatacttttttatgacaagaatgatgagtattttttagaaatgcaaatttagaatcagataaaaaaagatttagaaataataaattttttgttagttttgatattaaatttaataaatgaacacaaaatgataatataaaattatgtgaaaaaaaagaaaaaattttagaagaacatataaaaaatataaattatattacaataagtaaattaaaaaatattaaagatgaaaataaaatttttatttgattagatagatgagaaaaagagcatataagttatggaatatatgattgaaaattaaaatttcaatgaaaaatatgacatacaaattatgtaaagaaaatatgaaaagaacaagaaaagtttcaaattttagagcaaaaagattatgaaaatattactttaaaaataggtaataaaataattaaaattgaaaaacctatttataaacaattgactacaactcataagtattttgatgaaaattgaaaagaagaaataaatcttttagaattaaattgattacaagaatatcatattttatatatatttaaacaatgagaaaattgagaatattttgtagatttggaaaattgatgaaaatttattttaaattctaaaaaatattgattcactatcttagatagaaattgagaagagattaaaataatagattgaaatgattgaaaagaaataattgattattacttattatttgaatcagaaaaatttaaaaggattctagagataaatgatgaaataaaatattctgaaaatatgtttaatttgaaaaaatgatatatttctataattaaagatttttttgataaaattatttttgattataaaaaagaatgaaaagaagtaatttttatttttgaaaatcaaacatcaaataaaaaagatatttcaaataaatatttatgatctacaattctttcagatatagaggaaaatattataactaaatttaattatttaataaataaagaaagtaatgacaaatttcaattaacaccaaaaattaaaaaagaagatattttatttaaaaataataatatttatgaaatgttttgaaattgtatttttataaatcaagataatacatcaacttgatgtccaaattgtaaaaaaatatttttaaacaaatgaaaaaagtgaaaaatagaagaaattccttgaaatacacttttttgacattgaactggaaataatgaatgaaatatgaaacatttaacatatgaagaatatgataatttgtatgaaaaagatgaaaaatttaaaaaaaatcatacaaataaaaactgaaaaaaaatacaaaacaaatatttagctttaaataattgtaaattttatttgcaaaatcaaaatttttcagaatttaacttcataaaatcttgagataaccttgcaacctacaatatagccaaaaaatgactagaatatataaactctctaaactaa

SEQ ID NO: 286 - DNA, 3450 bp, unknown
  metagenome-derived sequence
  misc_feature (1)..(3450): Unk77 Cms1 native coding sequence; TGA encodes glycine
atgcaaaaatatgaagtaaaaaagactgttaggtttaaactgattccaattattaaaaattctgaaaatcttaaggtaagtttagaaaaacaaataaatctagaaaaatttataaaaaatttggaaaattacttaaataaattcaaaaatacttttttttatgataaagaaaaacatatttttaaaaacaaaattgaaattaaatataaatggctacaagaatttacaagaaataatttttatgaatttttgaataaaaataataaaaataaaaaatataagctatctgagataaattatttgccagttatttttaaagatagatttcaagaactagaaaatattatcaataacttaaaaattattgaaaatctaccagaagaaaatcaggaaaaaagaagtaaaattgcttactttataagacaattagctaaaaaagataattttgattttataacaagttttataaaatatatatcaaattcaaacaatccatacttagataaagatttaaaaaatttacaacaattagcagattttttgaaaaatgatttattactacttataaatagttatctaccttctcaatcagcttgattagaggtagtaaaagcaagtttcaattattatacaattgataaatatagtaatataaattttgaagataagttaaatgaaaaaaaagcagaacaaagacaaaaaataaaagaaataagggataatgataggtcatttagtaaaaaattttattgacaaagtataaaactagatgagaagtttttcaataaaatatgaataaaagaaaatttatatgaaaaaacattagaagaagcttatgactttataaaaaattttaaggcaaatgcaaaaagtcatttaatatcagatttaggaaaagaagaatttactacttatactaaatcttttaatacaattaaaaaagaagaaagaaaagattatatacaagatgcttttgatttaacttatgaaaattttcaaaaagttcatcctttatttgatatgacagaagaagattttaatgaattaatgaaattatctaaggaagtaagagagttagctaataaaaaaaataaaattttacaaaattattgagatattaaatcaaaagaacttgaagagaaaatacaaaataaaaaacttaaaaatcaagaaataacagaagaagaaaataaatttttagaaattaatgaattactaaaaattaaaaaagaagaaagatgaaaattttttaataaaccttgacaaaaagtatatacaaaaaattattatttattaaatgagctatttaaagatatagctatcaaaagatgatttttaaaagcagaaatagctggaattgaagaagaacaaaatcaagctagattattaaaatattggtctttaattacagaaaaagattgagaaaaatacttaattttaattccaaaagaaaatagaaaagaagtaaaaaataaaatagaagaacttaataatgactgagatataaaaatatattattttaaatctcttactcttaatgcacttaaaaagctttgttttaagaaaattggaaatacctttattaaacctgtttttcaagaattattgtttaaggatgataataaaccttattttaaaacaaataaaagatgaaaaaaacaacttaagagatatgatgaattaaatgaaaaagagcttattattttttatcaagatgtgttaaagtcagaagctgcaaatagacaattagatttagttgatttttgagaattaaataaaatttttgaaaaagattatagaaatattgaagagtttagaatagacttagaaaaagtatgttatacaaaattggttaaatgaatagatgattataattacaacaaattaataaatgaaaataatatcatagaatttaagattacatctcaagatttgaaaattttagaggaaaaagacgaaaaaatctttccaaaacataaaaataaagaacacacacaaaaatggttaaacttttggagcaaggaaaatccagaaaactattatcctacaagattaaatcctgaaattaagattttatatagagataagcttttagaaagagaaaattgaaaaaaagaaacaagatttaacaaagaacaatttactttatctactactttgggattaaatattcctagcaaaagacttgaatttagatttgataaaaccaatactatcaaagaaaaagttgagttttttaatgaaaaatttaacaaagaatttaaatgagaatggaattactgaattgatagatgaataaatgaactagctacattatctattataaaatggaaagatgaaacttatacttacaattgaaaaactatacaaaaaccagagtttgcaagaataaaagtatataaattaaaagatgagaatgtaacttgagaggtagaaaaatatgactgaacaaaaaaagaagtaaaagtaatagacaacatttcttattttacaggccaagaaaatttatttgaaagctttgaaacttgagtaatagatttaacacaagctaaactaataaattgaaaaattatcttaaattgagataaaaatacttatatgaaattaaaattattatcagctaaaagaagaatatttgaattatttgcaaattgaaaaataacagaattaaaatttgaaaggtgaaaaaatatattattttttctagataaagataattactattatcctatttattggtttacagaagaacaaaaacaaaataaaagtttaattgatgaaatagaaaaaaaacttaacaattactttaagtatatacaaaaaaataacctttttgaagataatgaaactatagaaaaaataaatcatttaagagatgctattactgcaaatatagtttgaataattaattttttacaaaaacaatttccatgaaaaatatttttagaaaatttagataaaacattactacaaagagaaaaattttcatataaaaaatgaaatgatggagaattaacacaaattgaagaaaaaatgatagattgacattttcagcaatcaaatactgatattagtagaaggcttgaatggtgattttatagaaaatttcaagaagattgacttgttccatcaaacttaaaacaaactatttttctaaaagatgatttctgaataaatcaatttggtataataaattatgtagaagtaaaaggtacaagctctatttgtccatattgcgaaaaaattactgaaaataaatgatgactcaaaaatcatataaataaaaatactgacgaaaatcataaactaaagcctaatttatcaaaaattgaagctaagaattgtatatataaagagctatataacaagaatttacaacttaattatgatagtatagctgcctacaacatagccaaaagatgatatgagtattttaattctttaaaataa

SEQ ID NO: 287 - DNA, 3648 bp, unknown
  metagenome-derived sequence
  misc_feature (1)..(3648): Unk78 Cms1 native coding sequence
atgaactcaaaagaacagaaacaacttgcatcaacatcggactattcttataacaaagcgatccgcttcaggctcgagcctgtggcaggacctcttccagttattgaaaaaggacattattctcttaatgatctaacggaaaaagcaggagtttttgccgataaatttgaacagtttatctataaaacatctgtaaatggcgcatttattgaaaataacaggggcgaaaaatttcccgacccgagggtttccattaaaaaacagtggcttaaattatatttcaaaaacgacttttatgcgtcgggcagaaagaaacagaaggaattcagtcttgataaatttaaatatattgaagaacctttgaaagagttcattactgaatggagaaacactctgagttctctgcgcatgattgcagttcagcctgatcattccaaacagcgccggagcgagattgctgaatgcttgtcggctcttgcatccaaatttcagtttcagcttctcagagacttttgcgaatatgcgaatcacaaggatgagcagaaatccctgaatgatcttaaaaatctttcagaagaagttgatcagattctgacttctcttgtaaatgattacctccctgctcagactgcaggcctggttgttgcacaaggttcaatgaattattatacagttaacaaaaaaccgaaaaattataaacaggaaatagagaaacttgaaaaggaactggaatctcttgatgctgaatatacaaagatgaagttgtataaagcagagcagaaaagcagactctatgaactgatcaacagcaacgcagatattgatacaatcaagcgcgaatgtccgttgtttgccgatcaggatgatcactgtctgaatgctgttattgacttaacaaaaaagattgatgaattaactcggataaaggatgaaaataacaaactttcagataagcagaaaaaagaacttaaagacttgaaaatagaaagagggtattattttatcaaaaaaactcgtgggaaaaaacatagttattattttaaagaatatgaaaagtattgtaataaatataaaaatattgcacttgaacgcggccggatccttgcacgcataaaaggcatcagatgcgaacagattgaaagtcagaatctgaaatactggactctgatctttgaaaatgaaggtaaaccgtatttgtgggcagttccaaaagaaaaaatgcaggaattcaggaaggagtttaatcatctggataaagggaacgccgttctttatattccgcattctcttaccatgcgggctttgcataagctctgcttcgctgaagaaagctcttttgccgaggaaatgagaaaaaaagactacggtctgtataagatgctttcagctgcaaaaaaagctacaaatgatgaaaaaagcagaaacttctgttacggaagcaccaaagacgacctctctcttgcttttttcaaagaactgatgaaaagtaaatttgctcatgaaattctggatttggatttttttgaacttgatgaacttcagacagctgaaaatctgaatgaatttgaggaactgcttgaaaaagcctgttattatatggaaccgctgtatttgaccaaggaatgtgcagaggagctgattgaagcatatgatattactgtattcagaataacttcatacgaccttgaagaacattacagaaatactcaccagactcctgagtcagagccgaagcggcatacaagagaaatatgggaaaaattctggaaatttaaaggtaaagaaggttcagtacgccttaatcctgaagtaaaaatccggttcagagaaaaagatgaaaatgtggtcagataccttgaatcgaaaggattcgatctgaaaaaaattcataaccgttatgcggaagatcagtacatactgactcttacattcactctgaatgcaggaaaacgctatccgcagcttgcatttgcaaaaactgaagatatctgcagagaaatagataatttcaatcagaaatttaatgaacagcactgggataatttgtataaatacggtatagacagaggtgaaattgaacttgcaactctctgtattgcaaagttccgcagtgatgatacatataaagataaaaatggtaaggttcatatgaaaccgactttcccgaacggagaaaatgatataaaggtttataaactgaaaaaagaatggtatggcaaaaaagtcaaatcgaatctggaaaccagaccgtttgatgaaagaaaagaaaaaagagttatcgcaaatatctcttattttattgacagaactgaagatcctgactggtttgaaaaatatacatgtacaacaattgacctcacgacagctaaagtaataaaggataaaattgttctcaacggcgatgtgctgacatatcttaaaatgaaaaaggaagcggccaagcgtgtgctgtttgaactggtagcagagggaaaactgaataargactgccggcagctrgtgtgggaaaaacatttttcatcaacagctttagtttttccgcatattaacgaaaaatgtgaaattgcttataatgcagccgctgatgtagtttattttttcgaagatgaaacgggcaaagattttgaaggtatgcttattaaagacgatattgcctatacaaaggaaaatgtgctgaacaatctgcagagttatcttgatacactgattgaggagcattctaaagactcttcggatattaacaagcatgttccgacagtttcaaagctgaaccatctcagggacgcgcttgtggcaaatatggtcggtgtcattatgtttctccagaaagagtatccgggaattattattcttgaggatattgaaaaaaatctgatgcagaaacattttgaagatatctacaataatatttcacgccgccttgagtgggctctgatcagaaaactccagacactcagtctgatcccgcctcacatcaaagatataatcgaaataagggaacgggcaagaaataaaaacaaggaagagtcatcatttcagctgggtgctcttgtttttgcagacaagaaaaataccagtgcgaagtgtccttactgtgataaaaaatggaaatggggaggtaaagaaaaagaatataaatttacgcagcaccgttatatttgcggtgaaaaacattcctgcggtttcgatacatacagtataggtaaagattttgaattcctgaaggatattgatgaccctgataaagttgcggctttcaatgttataagaaaagtgcttaattataaaacaatttcaaaatttgaaggtaaaatatcagaaaaagcagacaaaaacggtttcggacataaaaaagaatcatctcagcataaaaaatccggatctgcttcaatttcttatagaaagccaaaagtaaaaaaggaagagaaaagggaaaccgtaaaaataatagaaactttaagcaaaggaaatgccggatcagtaataaaagcattaaagaaactgaaaggtatgaatcttattcaatctgatatagaattattgtctgctgttctgaaaaaacgctctgattcaaaacagagctttaatcctcaggttaaggaatataaaaaattagcagaagaactaaagaaacaggcaggattctga

SEQ ID NO: 288 - protein, 31 aa, Unknown
  Sequence motif in Sulf-type Cms1 nucleases
  MISC_FEATURE (1)..(31): sequence motif found in Sulf-type Cms1 nucleases
  MISC_FEATURE (2)..(4): X=any amino acid
  MISC_FEATURE (5)..(5): X=Y, F, or L
  MISC_FEATURE (6)..(8): X=any amino acid
  MISC_FEATURE (9)..(9): X=D, G, or N
  MISC_FEATURE (10)..(10): X=Q, L, F, or M
  MISC_FEATURE (11)..(11): X=I, L, V, or W
  MISC_FEATURE (12)..(12): X=any amino acid
  MISC_FEATURE (13)..(13): X=L, I, or V
  MISC_FEATURE (14)..(14): X=any amino acid
  MISC_FEATURE (16)..(16): X=D, E, or S
  MISC_FEATURE (17)..(17): X=Y or F
  MISC_FEATURE (19)..(19): X=K, R, L, or S
  MISC_FEATURE (20)..(20): X=any amino acid
  MISC_FEATURE (21)..(21): X=L, I, or M
  MISC_FEATURE (22)..(22): X=any amino acid
  MISC_FEATURE (23)..(23): X=K, R, or S
  MISC_FEATURE (24)..(24): X=K or E
  MISC_FEATURE (25)..(25): X=A, I, L, or V
  MISC_FEATURE (26)..(26): X=any amino acid
  MISC_FEATURE (28)..(28): X=D, E, N, or V
  MISC_FEATURE (29)..(29): X=A, G, F, or V
  MISC_FEATURE (30)..(30): X=F, M, or I
WXXXXXXXXXXXXXKXXYXXXXXXXXFXXXW

SEQ ID NO: 289 - protein, 15 aa, Unknown
  sequence motif found in Sulf-type Cms1 nucleases
  MISC_FEATURE (1)..(15): Sequence motif in Sulf-type Cms1 nucleases
  MISC_FEATURE (3)..(3): X=Y, V, or P
  MISC_FEATURE (4)..(4): X=K or I
  MISC_FEATURE (5)..(5): X=any amino acid
  MISC_FEATURE (6)..(6): X=I or V
  MISC_FEATURE (8)..(8): X=F, A, V, or I
  MISC_FEATURE (9)..(9): X=any amino acid
  MISC_FEATURE (10)..(10): X=V, A, or L
  MISC_FEATURE (11)..(13): X=any amino acid
  MISC_FEATURE (14)..(14): X=L, I, or V
  MISC_FEATURE (15)..(15): X=A or V
FKXXXXPXXXXXXXX

SEQ ID NO: 290 - protein, 12 aa, Unknown
  conserved motif
  MISC_FEATURE (1)..(12): conserved motif found in Unk40-type Cms1 nucleases
  MISC_FEATURE (2)..(2): X=any amino acid
  MISC_FEATURE (3)..(3): X=S, H, or Q
  MISC_FEATURE (5)..(5): X=T or H
  MISC_FEATURE (6)..(7): X=any amino acid
  MISC_FEATURE (9)..(9): X=V or L
YXXLXXXAXEKL

SEQ ID NO: 291 - protein, 9 aa, Unknown
  conserved sequence motif
  MISC_FEATURE (1)..(9): conserved motif found in Unk40-type Cms1 nucleases
  MISC_FEATURE (1)..(1): X=L, F, or I
  MISC_FEATURE (2)..(2): X=Y or F
  MISC_FEATURE (3)..(3): X=Q or K
  MISC_FEATURE (4)..(4): X=I or L
  MISC_FEATURE (5)..(5): X=F, Y, or H
  MISC_FEATURE (6)..(6): X=N or S
XXXXXXKDF

SEQ ID NO: 292 - protein, 7 aa, Unknown
  conserved sequence motif
  MISC_FEATURE (1)..(7): conserved motif found in Unk40-type Cms1 nucleases
  MISC_FEATURE (1)..(1): X=N, S, or T
  MISC_FEATURE (5)..(5): X=any amino acid
  MISC_FEATURE (7)..(7): X=W or F
XLFTXYX

SEQ ID NO: 293 - protein, 9 aa, Unknown
  conserved sequence motif
  MISC_FEATURE (1)..(9): conserved RuvCI motif found in Unk40-type Cms1 nucleases
  MISC_FEATURE (2)..(2): X=L, I, or M
  MISC_FEATURE (4)..(4): X=R or L
  MISC_FEATURE (5)..(5): X=G or W
  MISC_FEATURE (7)..(7): X=N or K
  MISC_FEATURE (8)..(8): X=S, E, or N
  MISC_FEATURE (9)..(9): X=L or H
GXDXXEXXX

SEQ ID NO: 294 - protein, 7 aa, Unknown
  conserved sequence motif
  MISC_FEATURE (1)..(7): Conserved RuvCII motif found in Unk40-type Cms1 nucleases
  MISC_FEATURE (1)..(1): X=I, V, or F
  MISC_FEATURE (2)..(2): X=S, V, or I
  MISC_FEATURE (3)..(3): X=F or L
  MISC_FEATURE (6)..(6): X=L or Q
  MISC_FEATURE (7)..(7): X=D, N, or T
XXXENXX

SEQ ID NO: 295 - protein, 11 aa, Unknown
  Conserved sequence motif
  MISC_FEATURE (1)..(11): conserved sequence motif found in Unk40-type Cms1 nucleases
  MISC_FEATURE (1)..(1): X=E or Q
  MISC_FEATURE (2)..(3): X=any amino acid
  MISC_FEATURE (4)..(4): X=T or S
  MISC_FEATURE (6)..(7): X=any amino acid
  MISC_FEATURE (10)..(10): X=N or E
XXXXSXXCPXC

SEQ ID NO: 296 - protein, 16 aa, Unknown
  conserved sequence motif
  MISC_FEATURE (1)..(16): conserved RuvCIII domain found in Unk40-type Cms1 nucleases
  MISC_FEATURE (1)..(1): X=G or C
  MISC_FEATURE (3)..(3): X=any amino acid
  MISC_FEATURE (4)..(4): X=L or I
  MISC_FEATURE (6)..(6): X=A or T
  MISC_FEATURE (8)..(8): X=I or N
  MISC_FEATURE (9)..(9): X=I or V
  MISC_FEATURE (12)..(12): X=any amino acid
  MISC_FEATURE (13)..(13): X=G or W
  MISC_FEATURE (15)..(15): X=E or T
  MISC_FEATURE (16)..(16): X=F, L, or Y
XDXXAXYXXAKXXLXX

SEQ ID NO: 297 - DNA, 7356 bp, Unknown
  metagenome-derived sequence
  misc_feature (1)..(7356): contig encoding AuxCms1
  misc_feature (275)..(4168): AuxCms1 coding sequence
  misc_feature (6498)..(7305): CRISPR spacers
  misc_feature (6598)..(6625): CRISPR spacer with BLAST hit
ctctctatagagagcaactttcctgcaaatctacacaaaagattataaatcagcaatattctctgtcaagttttttgacatcttttaggggggtatattaatcaaaaaattagagcttttatataagtagctatctatcagaatattatatttcaacaactactatattctcttcttgtatacacgcaggattgcaaaaaaacttacaggcatattgttttattcataaatatcatttatttttaaccttaataatttctaatacgaattgattatgggaaaaaatgaaaacaaataccagttatcaaaaacattacgttttggactaacactaaaagagaagatttcgaataatgagaaaacaccttaccaaagccattctcaattcagagatttaattatcctttcagaaaacagaatcagagaaggtatcagcactccccaaaaccgtgacttaccctcttttatccacagaattcaaaattgcaccgattttatcaatgatttcatccatgattggtggatgattctgatgcacacaggacaaattgaattggacaaagactactataaaagcctaactaaaaaagtgggatttgtaggtttctggtacaaagagaacaaaaaaaagggtggaaaaacgaagcaaccacaagccagaaacataccaatgggtgagcttagacatctttgtccccaaaatactaaggagtgtgccacatacatcaccgattattggaaagatcttttgataacagcaaccaacaaactgtatgaaagcagtgaacaacaaaagaaattcatcaaagcgatggagcagaatcgcacggataacaaacctaacgaaatagatctgaaaaaatcttttttgagtctggtatctgtgacaatggaactgctaaaccctattctaaacgggcagatactattcaacaaaatggacaggctcgatatgtctaaaaaaagcgacaatgatttcattgatttcgtcaatgatcacgaaacggttcgtgaattaaacaatgacattgaagaaataatcgctgatttcaaagaaaacggcaataatgtaaactattgcaaagcgacacttaatccagacacagcattaaagcaacacaacaacaatattccaaatgatatagcaactgatttggaagagctaatgatggacagcatcgtcggaaattatgatgatgtcaactcttttatggataattatgtttcaaatttatctgcaaaagataaaataaaaaaaatcaaagactccaatataagccttatttatcgcgctatcctcttcaaatacaagatgattccggcaaacgtaagaagagatatagcccaaggaatggccaaaaagctcaataaagacgaagagaatatctacagttttctatgcgagtttggcactttgcgtactccacaaaaagactacgctgatctgaaggacaaggacagtttcaatcttgacaactatccattgaaagtggcgtttgatttcgcatgggagggattagcaaaagcttggtatcacgaccaatctgattttcctattgatccatgtcgtgattttctacaagaaaattttgatgtgaacttagaggaagaccaagaagacgaatattttcttctgtatgcagatcttatcgagctaaacgccttattatcaactctcgacaaagggaatcctgcagaccccgactcaataaaaaatgaagcattggagatggtcgaatacataaattggaattcacttgacaaaaaaaatggaaactactacaaaaaaataatcaaaaaccgtctgaaatcttcgaagggcaacgaaacgtacgaaagaataaaaaaagagatttccatgagccgtggacgtcttaagaacaaaatagaaaaatatgacgatctcacttctcaatacaagcgtattgccatggatttaggaaagaaattcgcctctttacgagacaaaattatagctgcgaatgaggataacaaggtgactcactatgcaatgattcttgaggattccaattgcgacaaatatctcttgttgcaaaaagtaagcaataacatttatcattgtatgagttacgattcttcagatcccaaagcttactatgtcgactctatcacatcttctgcaatagcaaagatgatcagaaaggaaacgaatccatccaagataagagagtatgctgaattagaagagaaagaaagagagagacggaacgttgatgattggtgcaggtttataagcaaaaaagaatacgacaggaggtatcagttgaatattaacaatggtttatcttttgaggcactaaaaaaagagatcgattccaagagttatattttggtgaaaaagaacattagtgttgattctatccgtgaacttgttgaaaatgaaggatgccttcttttccctatcgtcaataaagacctcacaaaggaaaggaaaacaacagaagacaatcaattcacaaaagattggaatatgatattctctgggtctgaaaccaattggagattaacccctgaattcagagtgacgtatagaaatccagtaccaggatatcctaatgacaaatttgggtcgaaaagatattcaagattccagatgaacgctcattttgtatgcgattttattccatcctctaattcatacacatccaacagagagcaaatcgccatattcaaagacgagggagaacagaaaaagagagtagaggaatttaatcgcaccctatcaaacatcaatcaaaaattctatgtcattggtattgatagagggcaaaaagagcttgccacactttgtgtcgtcgaccaggataagaaaatacacggagattttaagatctacactcgcaaattcaattccgaaagaaagcaatgggagcattattctctcgaaggagaaaaagggacaagaaacatccttgatctatctaaccttcgtgttgagacgaccattataattgatggcaaaccagaaaggagacaagtgcttgtcgatctgagtgaggtgttggtgaaggataaagaaggaaattacacaaagcccaacaagatgcagatcaaaatgcaacaaatggcttatgttcgaaagcttcagttccaaatgcaggcaaatccaaccgaggttttggaatggtatgagcagaatccaacagaagagttgatcataaagaatctcgtcgacaaagagaacggagaaaagggacttatctctttctacggaacagcacttgtagaactagaccagacacttcccgtctcaaaaataaaagagatgctcgaggaatttaagatactgaagcaaagagaaagcaaaaaggagaatgtgcaaaaagagctgaataaccttacacaacttgaagctgtcgacagtctgaaagcaggaattgtcgcaaacatggttggtgtgatctcatatatcttaaagacactggattataatgcctatatctcactcgaagatttgtctacagtgcaatccagcaccgaatttgcaagtggaatatcaggagcaatcaccaaaatgtcgagagaagaaggaagaagaatagatgtggagaaatatgccggtcttggattgtataatttcttcgagatgcaattgctacgaaaactacaccgcatacaaacagacaacggaaacattcttcatcttgtccctgctttccgtgcccaaaagaattacgaccacatcatggtaggaaaagaaaaaataaagaaccaatttggaatcgtgttctttgtagacgcggcagctacatctatcaaatgcccacgctgtggagcggtcaatgaggataaattcaatccagataaacaaaagtacccagatgcagaaaaagggccaaaattgagaaatcgcaaggagcagtcaggcaaaaaagtatgggtaaccagagacaaggaagacgacgaccgtatcaaatgctattgctgtggattcgacacaaaggaaaagaacgaaggaaatccttttatgtatatcaagagtggcgacgacaatgcagcctatcttatatcagatttaggagttgagtcttacagaaaagcttatgaattagctgcgactgtagtggaagacagaaaaaaaacattaactaacaatttaaatcaaagcaactacaaaattagatttttatggcacactatgtattagctattgacgagacaggaggattcatgacatccccttttgataatcaaaaatggattaaatctttttcatgtggagtttgctttattgataagacggaagaggatataaaaaacatctttgtcaaattatataatgacttcaatggctgtagtcctaataccaatgatttgaaaagcatcttgagaaacgaggcctttcattcaaacaaactttctgaagataaactaataaaatgcaaagatgcctttgctcctattatcgacaaagcattttcttctaaagacaagccttctctttacgctaacaatcaagactggtggcttacatccgtggttgttgtaatcgagttgtttttagactcgtataaattccagagcaatgacacgatcgacatttttttcgatggaagaaaagacaccacttggggagctcttgacgaaaacacctcgccttacgaccctaataatgaccaacaatgggatatatacaagcaataccacaagtttttgaaagaccaaatatggaattatataagtccaataatgactcatagaagactaaatataaaactatactatgggcaagattcaaacaatgcaggcattgctgtcgccgacattgtaacaaaattggttgcaagaggattatcaaaaaaacaattcattgaagggattcccgttgagactcgttcctgcagacaaataaacaacttgaatagcccagaaaaactatttgagaacgaccaaatcattgaagcgtacaccacaattcttcacgaattagagaatgacgacaacaaacacattggaatggtgtccacgattctcaacaaacttaaccagcaggaagaagactatgctattgtatggagtctgttctacgattttatcaaaaacagaatagaagaaaggaagctggaatcaagccagcaattggtggagattttcactggagaactgaaaaaaatccttccggaatggagtaacaaagtgaaagggctgaaagaactcaactgcaccgattttattattttaatcaatgaatattcctcccatttaggaatagcgacctctatgcctttttcatttgatgaatttgagaaatacaacaataaatttgatgaatttgagaaatacaacaataaatacgaaggacgacttcttagacgttgggaaaataaaatcaggtttaatctaagagctgctgaaatctgtttcaatggatatgattttaagacaattcaggaatccatgtctgatttatgcgacaaacaagacaagctgagagaaatgcttgatgggggaaaagacaaccattcgtccgcaatattgggcacattaggacaagcatatgcttttcttaatgaaacatcaaacgccgaaagtaaattcaaaagaagtctggagatttctgattacaagaaagaacaaacatattcatatatattcacaatctgtcataaggttggcgacgttgagaaatgcaaagaatatttccgtcttagtaccggcatagaagcatcagattatctatccaaattggaagaagacagattacgtaaattcaatctagtgtcgtacgagaaactacgagctttagagataaagaaaaacggaagaaccgagctaccgagatttgacattgagaatcacagtgatctaggaaatgaatatcctattccattaataaaaaaatgggctgccataagtctttatctggagaataaagaggagaataaaggacttataatgagtttgcttaatgaatcagcagaatcatgcattaaaggaaaaggatttgtcataagagccatggcgattccaatgttccagtgtgtttctttaataggctccacttattctcaatacgagaaattcatcaacgacctggcaaatgaatgccctggatttgcggaatatgcagaagcagtgccaaatataaaaacattggacaataaattagacatttgggaccgtgctcttttattaccgttttattacgcataatccagtccacattacaatacaacaaaaggaagatgaagcgacacacttcatcttccttttgtttttagcctatcccttccctattcctaaagactcacatttttcaagattctctacctatatccactacctatatgtaatcactgcgtgatatcataaaactgttttatatcggtagatataataaatacgggacagatattcccctttaggggatatacctagtaatatttgcaattcgtcgaattgacgttaaactaaaaaagaaaaagatatctaacagtactctatcgagcatcgtaaaaattgattgtttaacttctatctacaacagtagaaatctaatactctctatagaggtggcggtaatgccgttcaactacagacatctacaacagtagaaatctaatactctctatagaggcgttacattcatgacccgtctgtaccaatctacaacagtagaaatctaatactctctatagagtagttaataactgctaaaacctaactgagatctacaacagtagaaatctaatactctctatagagtcaagaagaaagtaggaaagttcttctctatctacaacagtagaaatctaatactctctatagagaaattgatttttttcatagaaataattatctacaacagtagaaatctaatactctctatagagaaccaaacacactaactgagggagattattgatctacaacagtagaaatctaatactctctatagagcttatatatgagttaataggaatataaaaatctacaacagtagaaatctaatactctctatagagatcaaacaatggtggaagaggctattcaaatctacaacagtagaaatctaatactctctatagagaagaaaaaagaagagaaaacagttaaaaatctacaacagtagaaatctaatactctctatagagattaagactatggaaaagatttttaattatctacaacagtagaaatctaatactctctatagagttatactggaaagggtgtttctgctgatatctacaacagtagaaatctaatactctctatagagagttgagcaatgttggattaaaacacatctacaacagtagaaatctaatactctctatagagagcaactttcctgcaaatctacacaaaagattataaatcagcaatattctc

SEQ ID NO: 298 - DNA, 10007 bp, Unknown
  metagenome-derived sequence
  misc_feature (1)..(10007): Unk15Cms1-encoding contig
  misc_feature (3983)..(7498): Unk15Cms1 coding sequence
  misc_feature (9468)..(9951): CRISPR spacers
  misc_feature (9504)..(9531): CRISPR spacer no. 1 with BLAST hit
  misc_feature (9631)..(9659): CRISPR spacer no. 2 with BLAST hit
actataaaaattttgaagaaactatagaaacaaaaaacatttatattacataatttaaaatatttaacatagacacaacaatcacatttcttagaacaatcattgataattaaaaacaaacaaatgaaaactaattactattaaggagggcataaaatgaacgcacaaaattcaatctgggacaaattcacaaacatgtacagtcttcaaaagacattacggtttgagttaaagccgattggaagaacattaaaattaatcaaagaaaaaaacttaattgaagaggatgaagaacgagagaaagaatttaatcaaatcaaaaagataatggatgattattacaaagaattcatagaattatgtttatcaaaactaaacattcctaatcaagaaatagaagaattcaagaaaacatatgataccttaaaaaaagatcataaaaatgaaaaattaaaagaacaatatgctaaaaatcagactgccttaagaaaattaatttataatagcatcaaaaaaacaaataattttaattacctttttggaaaagaattcataaatcaaacattaccaaactggttagaagaaaaaaacaggttagatgataaaaaattagtattaaaatttaaaaaatgggttacttattttgaaggattttttgataatcgaaaaaatgtattctcagaaagagagattccaacttcaataatatacagaatcgttcacgataacttaccaaagtttttagataatatctctaaattcgatgaattagaaaaattatctgattttgattacaaatctattgaagatgaatttaaatccgagttaaatggtaaaagccttcatgaatttttatccttaaataattttgaaaactgcttgaatcagtcaggaatagaaagatttaatcttattgttggaggaaaaaccacagaaaacaacgtaaaaataaaaggattaaatgaaaagattaatgaatattctcaaaaacaaaaagacaacaaagaacaaaaaaaaataagaaccctcaaactttcacctttatttaagcaaatcttaagcaacagggaatcagaatcatttattctagaaaaaatcaaagacaaaaaagaattatttgaaaaaattgataatttctacaaatcgttcaatgaattttcaaataaactaaaaaattcagttgaaaaactaaaaaattgtaaccatgaaaacgtttatgtgagaaatgacaagcaattaactaagatatctcaggaaatgtttggaaattgggatgagataaatagtggcttaagagcatattatggatcaaaaccaaaaaaaaacattaaatcgttaatgaaaagcaaatatttttcaatcaatgaaattgaagaaggactcaagaytctggaaactgataacaaacaatcaatagtagaacatttcttaaatttcaccaagaaatataayaatacaaacataaacttatttgcagatatcagcgaaaaagcaayagaattctataaaataaatagaaatgaaaaagagaaattaactgaaaaaaayattgaaacaatcaaagaatttttagattcaattatggctttatatcattttttaaagccattgcaccttgatttacgtaaaacagaaaaagagaaaggaagcgaagcattagaaacagactctgatttttacaatgatttcaacgaggtttttgaagaattgagtcaaattgttcctttgtacaataaagttagaaactatgtaacacaaaaaccatttagtacaggcaagtttaaactaaattttgaaaatcccactttagcaaatggttgggatttaaacaaagaaaaagayaattatgctgtaatcttaagaaaaattaaccagaaaacaaaaaaatatgattactatttaggaatcatgtcaggcagcgataaaaaaatttttgagaaaaataaaaataaaaaygacaacaaagattattatgaaaagataatttataagctcctacctgatcctaagaaaatgttgcctaaggttttcttttgtgagaaaaacaaagcattctttaagccttcagaagaaatcttaagaatcaaaaactcatcttcacacactaaacatggcagtccaaaaacaggttttgaaaaaaaagagtttgatttaaatgattgtcacaaaatgattgatttttataaaacaagtcttgaaaaacacgaagaatggcgtgaattcaattttaaattcaaagagacaaataaatatgaggatctatccgaattttatgctgatgtagcaaaccaaggatataaattatctttcacaaacattgataaaaattacattgatgaattaatcaatcaagaaaaactttatctttttcagatctggaacaaagatttttcagaatattcaaaaggaagaccaaacattcatacaatctactggagagaattgttttctgaacaaaatctaaatgatatagtgtataaattagatggaaaagcggaattattttatagagattcttcaattgaaaagaaaataacgcacccaaaaaatacccctataaaaaataaaaatccaataaaaaataaagaaacaagcaaatttccctacgatctgataaaagacaagaggtattctgaagaaaaattcttctttcattgtccaattactttgaattttaaggctaaagatcaaagtaaaagaattcataaaatcgtgaataactacattcagaagttaggagaaaaaatcaatgttttaggtatcgacagaggggaaagaaatcttgcatattattctcttattgattcagaaggcaaaatcatcgaacaacattcatttaacataatctcagataaattaaaacgtaagttcaattatcaagaaaggcttgatgaaatagaaggcaacagagacaaagccagaaagaattggaaaaagatcgaaaacataaaagagatgaaaacaggatatctatctcaagtaatatataacattgcaaaattaacaatagaacacaacgcaatcatcgttcttgaagatttaaactttgggtttaagcgtggaagattcaaaattgaaaaacaaatatatcaaaaatttgaaaaaatgttaatagataaaatgaattatttaattttcaaagacagaaaagaaaaccaaactggcgggtgttttaaggcatatcaattaacaaataagtttgaaagtttcaaaaaattaggtaaacaatcaggcatcatatattatgttgatgcatacaaaacatctaaggtatgtccaaaaacaggatttgtaaatttattatatccaagatttaaaaacatacaaaaatcaaaagaataccttaaaaaattcaaatacatcaaattttcaccagaagataacttgtttgaattaaatttcaattattctaattttttctctgaaaacaaaaataaattaattagagacaattggtcgatatggtctaatgggattaaattagtacaaaaaagaaacaaagacaaaaacaattcttgggaaacaaaagaaataaatgttacaaaagaattgcaagaattattccatcaaaacaatattgattatagttctggagaaaatttgattaaacaaatcatcaatattgaaaacaaatcattctacgaaacactactaaacttaataaggttgattcttaagttaagaaattcatattctgattatgaaatcaagaatttcaaaaagaacttaggagatcaattcaatgaaagtaattatgactacattctatcttgtgtaaaagacaaggacggaaacttttttgattcccgaaatgcaaaagatgatgaagtaaaggacgctgatgcaaatggtgcttatcatattgcattaaaaggtctaatgttaattaataaaataaaaactgcagatacgagtaaaaaaattgatttgaaagttgataggaatgattatttgaattatattatcaagaaagcaatttaagatggaaaatgcaacaataaaaaatccaaaatacagttatatgaaaagtataaggttcaacctaatagatactgacaacaaattatctgatttaaaatcaaatagtaatcaagatagtataattaatttggacaatattttcagttcatatgataaattaatcaaagagttcaaatcacttttttttgaagttgacaaaaataaagattacaaaagaaataactctgaaaattatattcttaaaagaacaatcaaaattaagaagcaatggttcaaaacatattttaaggaaggatggaacttcaaggaagaaaaaaaacaagagatcgaaaaaacccaaacaaaaataaatgaaactgtctctaaatttgagaatctatgcaaacaactgagaactgatattgatcatgataaaaacagggcacataaaaagcatagaaattctaatttctcatcgattcttcaacaaatcaaaaacaaggatgtattctatttattaaacgatttagttaaacagtcgataaataaaaatgaagtctctaaagttaattcattaataaaagacttcagttcctttgaaaaaaaattaaatcaactatcaaaagaatatttagcttctcagagcttaggaatcgaactatatcgaagttcttttaattattacaccttgaataagtcttcaaaacattatctaaaacaaattgaaaaaaagattcaaaactataaagatgagaaaaataaaacacatattgaatttcaaaacaattcaattaaagtaaatgatatgaaattgcaacttacttcaaaagatttagaagtaatggaaaatataaaaagtgaactaaaaatcaagtttccactaaatcttgaagaaagtaaatatttcatgaaattattcaaagcaaaattaaaatccgatttgttcaaagattgtcaaaaaaataatgaaattaaggattattcttgtttatttaatgagaataaaaaattaaaaaaaatatttgatttgacaagagaaatacaaaatgaaaatgaatttaaagaaatacaaaatttaaagaaagacagaggggaaattttaaagtcattcgaaaattggaaaaactttatcaattcatacagaaaaatttctcaagattacggaagaataaaaacaaatattgctaactatgaaaaagagaaaattgattcacaaaaattgaggtattggaacttattcttaaaaaaagataatcaaatatatattctgttcgttccaattgaattcagacaagatgtcaaagagaagatcacaaatgcaaataccgttaactcaccaaataaaatatttatgattaaatctctaacaaaaagagcgttacataaactttgttttaatgagtatggtagttttttaaacgaaatgaaaaagaaaaagaaagaaacatataatgaaatcataaaatttaaacaaaaattcagagaagaatttgagcaaaataaaattgaaaaattaaatcaagaactaatacaagagctaaaaaagaaaaaaataaagtttgaaaatgatgagttaaagagatctaaaaattttgttggttttatgaagaattttgaaaataaaaaatatggtcaattcaaaaaacagtttaaagaaaaaattgaaaaattaaatcaaaaatatactaaacaaaaagaggaaaaaactactaaaatattaaaagaagtcttgcagtctgattatgcaaaatcaaggctcgatttaaaagattttgatcttcaaaaagtgtatctagctcagacgtcaaatgaatttgaagaagaattagaaaaagaatgctataaaattttaccatattatattgataataagttattgtccgaattagaaactctatttaaagtgtttaaatgtaaaatccaatcttatgatcttgataaaagatttaaaaatgaaacacaaacaccaaaaagtctagaaaaaagacatacaagagaatactggaacgaattctggcaaaaattaaatcaatcaaaaataagattaaatccagagatacgagtcaactataaagaaaaagacaatgagatggaacgatacctctggaaaagatataatgtcgataaagaaaagatcaaagaaaacaaatatggttttaatcggaatctgcaagataaatatatcatcaacttttctttcttagtaaacacaggtaaaaaatttttagatcttggatttgcagattcaaatgagatcaaacacgaaattgaagatttcaatattgatttaaataaaaagatgaagaatccttttttttgtgggatagatattggagaagtagaattagcaagctctgctatctacgcctttgatgataaacacaaatatcaattcaataatcaaaagttcataagaccagttattcccgataatttgccgataaaatgtttaagactaaaaaaggaatattatacaaaaagtagaaaaccaagtaaacaaaaagtaaattttaaaaaaatcgaagaaagacagataatatcaaacctttcctattttagtgatcaagaagagttatttgatgaaatttctccctttgccttaaacttaacatgttctaaagtaataaatggcgtcattatcgaaaatgcagacatacttacttatttacaatacatgaaaaaattagctaaaagaaggttatttgaaatttattcaaaaggatttcttgaaacagataacaaaaagcataattttcaagatttgaaattagattggcaataccctaaagaatcaaacaaatacaaatcaaataatttaatcttatgcgataaagaaaataaaattgtaaaggcaaaaatatttactttcatctacgaatatgaaggaattaaaaccaaaaatggagaatatgaatttgattcaatgaaggattattttaacaaatatttaaataaattaaagaagataaaaaaaagtaatgataataaaataataaaagaagatattcctagaataaacaacttaagagatgcattagtttcaaacatgattggagtattaaacttatttaataaatttgttgacctatatgtcgttttagaaaacattccaaataagaataagcaagatgaatatctcataaaaaggttagagtctgctttattccaaaagtttcaaacttttggaatggttcctccaaatgtgaaaaatttaataaagattaaaaaaatgctacagactaaagaagataaagattccggaaaagaaatccagattggcaatatcttatttatcaacgaaagaaaaacaagtcaaacatgtccttattgtgaaaacagtgataacaatcaagatcatgaaaaagggatttttttatgttcaaaatgtaatttttcaactaatgataaagaaaaaatacatttaactgaattaaagattttgaaaagctgtgatatagttgcagcatataacattgcgaaaaaaggttatcaatttatcataaatggaacaaaacataaaaatatcaaatctgaatgatttcatcttttgtccaagaagtatatactttcacaatctgtattcagattttgatgaaagtacatatcaaagcacctatcaagtaaatggaagaaatgctcacaaaaacattgatgataaaaactattcgtcaaagaagaacatattagaaagcattaatgtttacagcgaagaactcggactatttggaaaaattgacttacttgacgttaaaaacaagatactgattgaaagaaaaaataaaataagcacaatatatgaaggatattaccttcaagtctatgctcaatatttttgtcttttagaaatgggttacaaaatcaaaaagattgtttttcattcattatctgataataaaagacataatgttccattaccaaccgaaaaagacaaacaaagattaaaagatattattaaacaaatgaatgagttttcattggataacaaattttcgcagaataaaaaaaaatgcaaaatgtgcatatacaaagaattatgtgattattacaaaaatgatgagtagacctgattttatggttaaacagattttgtttttggagagtgataactccaaaaaaataagatttcgtaattcaaacctactattagtagatgagaacaacaaaataatcttgcaacattctcttcatatgattttcttagtctttatttatggtgaatttacgataacttcagttctgatcaaaaatgcaaaaaaatatgctataccaataatctgtttgaattataatctcaaaccatatttttcaataattccggacaacaaaggaaatttccttttaaggaaaaaacagtatgataataaaaatgatttagcaattgccaaacacatcataaaaaataaaataaataaccaactatctttaatgaaatcgctaagatacaaaacacagaaggaaaaagaatccataaaaaaagtaaaatccatcattgataaaatcactccaacgcaaaatagtcagtatttattaggactcgaaggtaatacctcaaaactttttttcaccacatattataaaaacacagaatttgtgggaagaaaaccaagatgcaaatgtgatatcttcaatcttctctttgatataggatattattatttatttaatttcattgaggcaaatcttgaattatacggttttgatacattttatggaatttatcataaattattcttccaaagaaaatcattagtatgtgatctcatagaaccattcaggtgcatcattgatcgaaagatcaagaaaagctataatctaaaacaaattgataaaaaagatttttacctcaaaaatgggcaatatcatataaaacgcaaatcaagtaaaaaatattcaaagctattcttaaaagagattctcagctacaaagaagacatctttctttatattcagaaatattatcgttgtttcataaaagaagcaaacattgacaattatcctttatttaatatagaagcaaaaaaatgatgattttaacatatgatattcaggacgactcacttagaacaaaattttcaaaattcatcttaagttatggacggagactacaatactcagtatatgagataaacaatagcaaaagagttttagaaattgtaaaatcagaaataacttcgcgttttgagaaaagattttctcagagcgacagcgtcctaatcttcaacattacagcagagaaccaaatattaaggttcggatatgcaaaaaatgaagaaacagacttactaatatcttaaaaattgcaaacctcagtccttatttatcatatagaaatcaaaaaaacaatcaagatttcgcatttcgcggcctgaaatagccttttttgtgaaaaagacaggaacaaataaaaattataagaatgagttttagagccgacaagtctaaaatgatgtaggcaaaaagtagaaagactttagacgaaaaattaatatatcacctccacactacctgtttagagaacatgaataatttctactattgtagatttgcggatttgctcaatgcaacgttctcggtttagagaacatgaataatttctactattgtagatgcatccctgaagcctgctcaggaaaagtttagagaacatgaataatttctactattgtagatgaggaaatctatagtcatgttttgttaaggtttagagaacatgaataatttctactattgtagattatcccagcatctataagaaatgattcgggtttagagaacatgaataatttctactattgtagattatatagcataaattccaaaacctaaagcggtttagagaacatgaataatttctactattgtagatccatctattcctgatagttctatgaggtttagagaacatgaataatttctactattgtagatgcttggctgccccacatattggataatgtttagagaacatgaataatttctactattgtagataagatttattgattcaattgttggcttggtttagagaacatgaataatttctacta

SEQ ID NO: 299 - DNA, 10633 bp, Unknown
  metagenome-derived sequence
  misc_feature (1)..(10633): Unk19Cms1-encoding contig
  misc_feature (3933)..(7190): Unk19Cms1 coding sequence
  misc_feature (9208)..(10584): CRISPR spacers
  misc_feature (9310)..(9337): CRISPR spacer hit no. 1 with BLAST hit
  misc_feature (9375)..(9402): CRISPR spacer hit no. 2 with BLAST hit
  misc_feature (9439)..(9466): CRISPR spacer hit no. 3 with BLAST hit
  misc_feature (9566)..(9594): CRISPR spacer hit no. 4 with BLAST hit
cccgccgctcctgttaatatttgatggctacttggtataaatacctactctcaaatatattatcagattccaaataaatattttcgtaggacacgctatgggggtggagttagtttagaataaaaaatagattagaagttcagtataattttatttaaagggagacttgtattatgcaaacactatttgaaaatttcacaaatcagtatccggtgagtaagactttgcgttttgagttgatcccgcagggaaaaacaaaagattttatagaacagaaaggtcttttaaaaaaagacgaggatcgtgcggaaaaatataagaaagtaaaaaacattattgatgaatatcataaagatttcattgagaaatcactgaacggtttaaaattagacgggcttgagaagtataagactttatatttaaagcaggaaaaagacgataaagataaaaaggcgtttgataaagaaaaagaaaatcttaggaaacagattgcgaatgcttttagaaacaatgaaaagtttaaaacgctctttgccaaggaattaataaagaacgatttgatgagttttgcctgtgaggaagacaaaaaaaacgtaaaggagtttgaagcttttacaacttatttcactgggtttcaccagaacagggcaaacatgtatgtggcggatgagaaacgaacggctattgcgagccggcttatacatgagaatctgcccaagttcattgataacatcaagatatttgaaaagatgaaaaaagaagcgcccgagcttctttccccttttaatcaaacattaaaggatatgaaggatgttatcaagggtacaacattggaagaaatattttcactggattatttcaataagacacttacacaatcggggattgacatatacaattccgtaatcggcggcagaacacccgaagagggaaaaacaaaaatcaagggcttaaacgaatatatcaatactgattttaaccagaagcagaccgataagaaaaaaagacagcccaagttcaagcaactctacaagcagattttgagcgacaggcagagcctgtcatttattgcggaggcattcaaaaatgatactgaaattctggaagcaatagaaaaattctatgtaaatgaattgctgcatttttccaatgaaggcaaatcaaccaatgtattggatgcaatcaaaaatgctgtaagcaatcttgaatctttcaacctgaccaagatgtatttcagaagcggcgcttcattgaccgatgtttccaggaaagtatttggagaatggagcattattaacagggctttagataattactacgcaacaacctaccccatcaagccaagagagaaatcagagaaatacgaagagcggaaagagaaatggctcaaacaggattttaacgtcagcctgattcagaccgcaattgatgagtacgacaatgaaacagttaagggaaaaaacagtgggaaagtcatagctgattactttgcgaagttctgcgatgacaaagagactgatttaattcagaaggtcaatgaaggctatatagctgtcaaggatttgctgaacaccccttgtcctgaaaatgagaagctcgggagcaataaggatcaggtcaaacagataaaggcatttatggacagcataatggacattatgcattttgtaagaccgctgagcctgaaggatactgataaagagaaagacgaaacattctatagtctgtttacccctctatacgaccatctgacccagaccatcgcactctacaataaggtgcgtaactacctcacacagaaaccatacagcacggaaaagataaaactgaactttgaaaactccacattgctgggtggatgggatttaaataaagaaacagacaatacagctattatactgaggaaagataacctttattacttgggcattatggacaagagacataacagaatattcagaaacgtacctaaagcggataaaaaggatttctgctacgagaaaatggtttacaagcttctgcctggagcaaataaaatgctgccgaaggtattcttttcgcagtcacggatacaggaatttactccgtcagccaaactgctggaaaactacgcgaatgagacgcacaaaaaaggtgataatttcaacctgaatcattgccataaattaattgattttttcaaagactcaatcaacaaacacgaggactggaaaaactttgatttcaggttttcagccacgtccacctatgctgatttaagcggattctatcacgaggtggaacatcagggctataagataagtttccagagcgtagccgattcattcattgacgatttggtcaatgaagggaaactctatcttttccaaatatacaacaaggatttctcacctttcagtaagggcaagcccaacctgcacaccctctactggaagatgctctttgatgagaataatttaaaagacgtggtttataaactaaatggtgaggccgaggtattctaccgcaagaaatccattgccgagaaaaacacgaccattcataaggccaatgaaagtattattaacaagaatccagacaatccgaaagccacaagtacatttaactacgacatcgtcaaggataaacgctacaccattgataagttccaattccacattcccataaccatgaatttcaaggctgaaggcatattcaatatgaaccagagggtcaaccagttcctcaaggccaacccagatattaatatcatcggaatagacaggggagaaaggcatctactttactacgccctgataaatcagaaaggtaagattctcaagcaggacaccttgaatgtcattgccaatgaaaagcagaaagttgactatcacaacctgctggacaagaaagagggtgatagagccacggcaaggcaggaatggggcgtaattgagaccattaaggaactgaaggaaggttatctgtcgcaggtcatccacaagctgaccgatttgatgattgaaaacaacgccatcattgtgatggaagatttgaacttcggtttcaagcgtggaaggcagaaggtggagaagcaggtttaccagaagtttgagaaaatgctgattgataaactcaattaccttgtggataagaataaaaaagcaaatgaacttggcggtctgctcaacgcattccagttagcgaacaagtttgaaagtttccagaaaatggggaagcagaacggatttattttctacgtgcctgcgtggaacacaagcaagaccgatcctgccacaggtttcattgatttcctgaaacccagatatgagaacctgaaccaggcaaaggacttctttgagaagtttgattccatccgtctcaacagcaaggcagattattttgaatttgcttttnattttaaaaacttcaccgaaaaggcaganggtggaaggacgaaatggacagtttgcaccaccaatgaggacaggtacgcttggaacagggcgttaaacaacaacaggggcagtcaggaaaaatatgatatcacagcagaactgaaatccctgtttgacggaaaggtggactacaaaagcggcaaggatttgaaacagcagatagcaagtcaggaatctgctgatttctttaaggcattaatgaaaaatttaagcattaccctttcattgcggcacaacaacggagagaaaggagataatgagcaggattatattttatctcctgtagcagacagcaagggaagattctttgattcaaggaaagcagatgacgatatgcccaagaatgccgacgccaacggcgcttatcatatcgcgcttaaaggtttatggtgtctggaacagatcagtaagacggacgacctgaaaaaagtaaagttagccataagcaataaagagtggcttgaatttgtgcaaacactaaaaggataaattattatggaaaaatacaaaattactaaaaccattcgtttcaaattgctgcctgataaaattcaagacataagccgtcaagttgctgttctgcaaaattctacaaacgcagagaagaaaaacaatcttttgagattaatccaaagggggcaggaattaccgaaactattgaatgaatacatccgatacagtgataatcataagctgaaatcaaatgtcactgttcattttagatggttgcgtttgtttacaaaagatttgttttacaattggaagaaagacaatacggaaaagaaaatcaaaatcagcgatgttgattatttgtctcgtgtgtttgaagatttttttaatgaatgggaaacagtaattgaaagaataaatactgattgcaacaggccggaggagtctaagacaagagacgcggaaatcgctttctcaataaaaaaaattgcaaccaagcagatgtttccattcataaaaagttttgtttataatagtaattacaaaaacagcgaagaaacaaaaagcaaactaaccgctttgctaaatgaatttgaaacagtattgaaaatatgcgagcagaactatctgccatctcaatccgcgggcattgtgattgccaaagcgagtttcaactactataccatcaataaaaaacagaaagattacaaaggatacactgatgatattgaaaaaatagagaaaggaatgaattcaaaatttcattatgaaagaaaatatgaccagttgcttgaagaattaaaccttatcgctttaaaagaattaccattaatcgaattttattcgaaaatcaaaagctataaatcaaccagaaaaatcgagttttcagaagctgtttccaaagggttggcgtttgccgatttaaaaagcaagtttcctctgtttcaaactgaatcaaataaatatgctgagtttttagaactgaccggcaggataacgcaaataagtaccgcaaaaagtttgctttcaaaagataatcccgaagctcaaaaacttcgagacgaaattaagaaattaagaataaacaggggtgaatattttaaaaacaattttcataaatatattagcctttgcaatttatataaaaaaatagctgacaaaaaaggcagattaaaaggccaagtcaaggggatagagaacgaaaggattgattcgcaaagaatacagcactgggcgttggtgctggaggacaatttaaaacattctctgattctaataccgaaagagaaagtaactgaggtttacagaaaagtccgggcttcaaaggccgatagtacaagttcaagttcgtcattgtactactttgaatccatgacctatcgcgcattacacaaattgtgttttggtgtaaacggcaatacttttttgccggaaatccagaaagaactgcctgaatataacccaaacaaacaaagtgactttggtgaattctgtttccataaaagcaatactgataaagaaattgatgaacctaaactaatatccttttatcagtctgttttgaaaactaattatgtcaaagacaatctgaacctgcctcaaagtgtatttgatgaagcaaccgtccagacatttgaaacaaggcaggactttcagatagctttagagaaatgctgttatgcaaagaagactatcatttccgaaactttgaaaaaagaaatattagaagacaacaatgtgcaaatatttcaaatcacaagtcttgatttacagaggtcagaacaaaagaacctgaaagcacacacaaagatttggaacagattctggacgaaacaaaatgaaacggctaattatgatctgcgtctgaatcctgaaaccgccattgtctggcgaaaacctaaaaagacaagaatagataaatatggagcaggaacatcattatatgatccgaaaaagcggaacagatacttgcatgagcaatatactctttgtaccacggttacagacaatgctttgaataatgaaattacttttgcctttgaggatacaaagaagaaaggcactgaaatagttaagtataacgaaaaaattaatcagacattaaaaaaagaattcaataaaaatcagttgtggttttacggcattgatgctggcgaaattgaattagcaacgttggccttaatgaataaagacaaagaaccgcaattgtttacagtttacgaacttaaaaaatcggacttcttcaagcatggatacatttataacaaagagcgtgaattggtgatacgcgaaaagccgtataaagcgattcaaaatctatcctattttttaaatgaagagctttatgaaaagacattcagagatggtaagtttcaagaaaccttcaatgaactgtttaaagaaaaacatgtatccgcgatagatttaacgacggcaaaagtgataaatgggaaaatcattttaaatggcgacatgatcacttttttgaatttgaggatattgcacgctaagcggaaaatatatgaggaactgataataaatccgcaagctgaattaaaagaaaacgaaaaagaatattatctgtattttgataaagagggaacagaaaaagttgaaaagatttatcgaagcagattggattttgaacatattaaaccctatcaggaaattagaaatgacctgaatgcctattttaaaaatgttcaaaaaaatgaagcaaaagtggaagatcaaataaatcaaacacgaagagcgcttgtcggaaatatgataggcgtgatttattacttgtatcaaaaatatcggggcattatttctattgaagatttaaaacaaaccaaagttgaatcggacagaaataaatttgagggcaacatcgaacggcctttggaatgggcattgtaccgaaaatttcagcaagagggatatgtgccgccaattagcgaacttattaaattaagagaacttgaaaaatttcctttaaaagatgttaaacagcctaaatatgaaaacatacaacagtttggaattatcaaatttgtaagcccagaagaaacaagtactacttgcccttcttgcgagaaaaaagcttatgaattacaaaaagaaaagaaaggagaagaaaagcccgctgaaaacaaacgatatgaagcggataaaaaggcaggagttttctgctgtccaaaatgcggttttcataacagaaccaatccaatgggatatgaaagtttggatagtaatgataaagttgccgctttcaatattgccaaaagaggatttgaagacttgcaaaagcacaaataaatggaaccatacataacgttatcatttctgaatgattttatattttgtccgcgctcgatttatttccatcagttgtatggcgggctgaactatgaattatataaacaaaagccgcaaatagccggtgaagcggctcacaaacctatcggagataaaagttacagtacacgcaaaaatattttacaggatatggaagtattttctgaaaaatacaacatctgcggaaaagttgatgtgttcgatgatgcggcaggcaagcttaccgaaagaaaacgcgaaataaaaacaatctatgacggttatgtgtttcaggtttatgcgcagtgtcatgcgctgagagaaatgggctacacagtcaatgaaattgttatacatgacttggtgcataataagaactatccgatcccgcttcctgagaatgatgcgcaaatgcagtcaaagtttgaaaaactgatttacgatatgaataattttaattttgagagtgcagtccttgaaccgaacagatcgaaatgtgaacgatgtatttattctcaactctgtgatgtgtcgccatgttaagttatccagattttaaagagaaaatgattgtcgtagtctttaccagcgaaggccagcggttttcatttcaaaatgataatttgattgttgctgatgctgatgagaaagttattttgcaaaccacgtgctatcgcatgctggcgttgtggattgtcgggcattgtgttgtaacatcaggcctgctggaacgaagcaagaaatttgcctttcccatttatttgctgtccgttaatttccggtgcatcggcgtgtggagtacgcctaccgatggcaattttttattgcgtgagaaacagtattcatatcaaggtctggatatagcaaaacgcattgtgcggaataaaattcagaatcaaataattttattgaaaagcataagaaaaaaggaagaagagctgaaacgttctttggaactaatgaagaattatgaaaaccaggttaatgattttgataaattgcaggaattgctgggcatggaaggtgtttcttcacggctgtttttttcggaatggtatggcgatatggaatggaaggggagaaagcctcgcgcgaaaagagatccaattaatgttctgctggatatcggctatacttttctattttatcttgtggagaatatgcttaacctttatggattcgatatttataaaggcgtctatcatcaattcttttatcaaaggaaatctctggtctgcgatttagtagagccgtttcgctgtattgtcgataagaaaataaagagcgcttataatctgaatcagattaataatgatgattttgatgtccggaaagggcagtactttttaaaatacgcgaaaagcaaagaatacacacgctggttgctggaggcgattattgagtataaggaagatatatttttatacacacaaagttattatcgcgcattcattcggcaaaaagaaataaatgattatcctgttttcaatattaatgaatctgttcacaaggcgtagccgtatgcttttagtgtcatatgatatcagcaataataaattaagaacgcagtttgcaaaatttttaaaaaaatatggatatcgcttgcaatattcggtttttgagattaaaaatagcgacagaatcatagagaatattacaacggaaatagaagaatattatggcgacaagtttgaacagacggacagcgtcatcatattcatcttgagcaaaacttgtgaaaaaataaaattcggctatgcaaaaaatagtgatgaggatttgataataatatagccgttggtaaatttgcaaaccggggtcttaatggcaaaaattggctgattttatggtgtttcagcaatttaatcttgcgcgtgaaagaaaaatgtgcttattaaacaactatatagccaggtgctataagttgttatctgtccaaaggacggattaaatttctactattgtagatangnaagtanttnctnnanaaacnngntcggtccaaaggacggattaaatttctactactgtagatgcaangngnnnnttgnggccatttaccaccgtccaaaggacggattaaatttctactactgtagatccaagtccccccgcaacatcataaaacacgtccaaaggacggattaaatttctactactgtagatacctggcggaggctaaccctccgcctatgtccaaaggacggattaaatttctactactgtagatgaatacttatcaataacctgctcttcgggtccaaaggacggattaaatttctactactgtagatcgaatatgcctttatttgagactggttgtccaaaggacggattaaatttctactactgtagattagcaacccactcagcataatcgttttccgtccaaaggacggattaaatttctactactgtagatagttagcgggttaattgcaattgcctgggtccaaaggacggattaaatttctactactgtagatgtaagataacgggttttccatttcctttgtccaaaggacggattaaatttctactactgtagatttcaagaagatcagattcttttttaattgtccaaaggacggattaaatttctactactgtagatatactttttaattctatcccctagtttgtccaaaggacggattaaatttctactactgtagatttcccgtaattttctggcgatatccttgtccaaaggacggattaaatttctactactgtagataccgggatcggctctccgcaatcttcgtccaaaggacggattaaatttctactactgtagatttatgttattacagagatatgggatattagtccaaaggacggattaaatttctactactgtagataaggctatgtccggcggtaagtgatttttgtccaaaggacggattaaatttctactattgtagataagtaagcttcaagacatctttcttgccgtccaaaggacggattaaatttctactactgtagatacgcaccttagcaagtaagggagggggacgtccaaaggacggattaaatttctactactgtagatacccatttctgtttgacccatttctttagtccaaaggacggattaaatttctactactgtagatgtaaagcgttattaatgctttcagagtccaaaggacggattaaatttctactactgtagatataagcccaaggcgggtcgaggtagagtccaaaggacggattaaatttctactactgtagatactggggattggtggcccacataaagtccaaaggacggattaaatttctactactgtagataaccggcgatacgcctgacgatttgcgccatgtccaaaggacggattaaatttctactactgtagataaaggttcaaaaacccatcgttttatttgattaaggtccaaaggacgga

SEQ ID NO: 300 - DNA, 10415 bp, Unknown
  metagenome-derived sequence
  misc_feature (1)..(10415): Unk40Cms1-encoding contig
  misc_feature (3)..(599): CRISPR spacers
  misc_feature (348)..(375): CRISPR spacer with BLAST hit
  misc_feature (2656)..(6153): Unk40Cms1 coding sequence
atatctacaaaagtagaaatcggatattggttttagagaagcacagtatattattcaatgagtaatctacaaaagtagaaatcggatattggttttagagctctgttgcatcagcgtgattacacatctacaaaagtagaaatcggatattggttttagagaaaaaaggatggtatcagacagtcaatctacaaaagtagaaatcggatattggttttagagggggagtaaccaataaacattatgaaatctacaaaagtagaaatcggatattggttttagagctggcacagaattacgtcacacataacatctacaaaagtagaaatcggatattggttttagagcaatacttcgaggagtggcaaccgaataatctacaaaagtagaaatcggatattggttttagagctaactcttgacatatcgccttgtataatctacaaaagtagaaatcggatattggttttagagtaatggagcaaagcctagggagatactatctacaaaagtagaaatcggatattggttttagagagcgtttaatgctttgccagctccaaatctacaaaagtagaaatcggatattggttttagagagcaaatttggcttattcaaaccaaaaagatacaaatcacgcacaagtgcaataacgactttttggcttgaataggtaacctctattatattaagacaaaggtttaggcattttttaaatgttcgctctaaaataaacatcacaactttcacttttattaattttaaagaacaattttttaaaagaaaataacatctttttcctcatgcgcatgcgacccgaaacgccctatcttctttctgcatccatcacacacactaaatattaaaacactatcaacgtcactaaaatgaggcttgtaccttaattctacctcactctgaatatttttcaatagccgtgcactattttttacctcaaaaaccgaatattgaacacgacgtccaaattttttcaaaaatttagcaaactttgttcttaatttatcattatgaaaatcataagttacaagcaacatttgaattttatcttattaatttaaaaaacggcatatcttcggtttcattaatcaatgagtaataatactgtctaatataaccaaaaatatcttctttattatccataataacatcagaaaatatctttaaatatttaccctgcttatcataaggtaaaaaatatttagccttggaaattttaaaatccttggcattaaattgtttaagagtaaacattttaagcaatgcggaatctataatgcacctaaaaggctccatcagatcacaagccaacgactttcgctgaaaaaataatttatgataaaaccctttataaacatcaaatccatataatctcaaaatcgaatccataaaattaaacagtaaagtatacccaatatccatcaaaatattctgaggatcctgtttagcacgaggcattcttctataccaaccgatatccccaaaatatagcctgaagtaattttttgtggaactaccttcaagcccaagcaaaactttttcatctccagctaaatctatcttttcagcaaatttcttataaaattttacgggcgtcttaattttttttgccttcgaaagaagcataaattgattataaactttatttttcaccaaatttttcgctagctcaaaatcattaagagaataatattgtcgcttccttaaaagagtattcccctcggcaccagcaccaatagtcgcatacacttcaaaattatttctggtaaaaaacaaagaaataccatatttcatgcaatttctaatcaaaaccgaagtaaaactacactcaccacagacaaaaacagccaatatcttataacaagaaagctgattaacaggtttattatcacgaaaaagtcgaatattatcattccaaaacttcaatttattatccatatctttatcaccaaaaacaaaaagtatctttttttctttaaaatcaggcaaagttaacatatttataaggggttaatgacaaagtggacgataaatacactgattacatttctgttcattatcaattacaggaaacctagatacatcaaataaacggatttgctcaatagtagactcaaatttcctcaattcttctccaataggcaatgaaatcggataacgcttattatcggtaagggaatgaataaaaagtttactaacgctataacccatttcaagcaagcaaaacatctgcgcataaagttgatagcgataaccgtcataaatagtttttactttggtctttcgctcaatcaaagcctcttcatctctatcataaatatcaattttcccaacgagaccatatttttcacaataaacctctgaaccctgaagataacgactagcagttgaatattcacctttatcaatactttcatgcttaattttcccgacaagttgcggtttttgatgatatgtcttttgatgaaactgctcatacaccgcgtgaaagtaaatcgaccgcggacaaaagataaaatcgttgatttttgagatttggatgtaggattgcatagtgaaacactatacaatatattttgtgtttcgcaagagaatttacccatagtctactcaaattgaaatctcattcattcttattaatttattacttctgatttacactgaatgaattccaaaccacgtttagcaatgttgtaggcagcgagcacatcaccaccatttaccttttttagtttttcgtgatttttagttgggaaccgtgaatcaaacccacaatgaacacaccgaataaaatcctttgattttgtttcattttgtctagtttttgagagaactctacaaaaatcattatgacttttatccaatttctctgtagcaacaccagaataccgccacgcaaacacgccatcatccaccctaaatatagtcaccttagaaatatcaattccaaaatccttatctttaagctcttccgcatttagcgttaacttcaattccccattttcaattttcgccagaccgtacctattcatagaataaccacaatttggacaaatttgtgatgtattggtctcatcagttatttgaataacaccaatttgaaaatctttattatttttctcacccgacagtacatctttttttagctcctcaacctttcttatttttgggactttttgggaatgaacacttgaggaacctttcactacagaatatccaagttttgacatcaatcgattctcaatcatttgatatacacttgcaccaaatgttttcctatagtttcctccctttcccgttttatctcccatattaagattttctaaagaaacataagcattatttgtttccaccctttcaccaataaatccaatcaaagctgacacatatccatttttaaatttttcagtattaaacaattcaaaatctctatttttttcaacttgactcaatctctcctccttaagaatttcctgagctactcgataattataaacagctccatcttcatcttcccaagacaaaattttcacagcatatgcaccagttttttccatttcgacctgttgcttctcttttttcgtttgtggtttacaccttatcggacagacaacaaccctttccctaccatcgccataatcaggatacattttttttaattcatctctttttttacaggcatcctgtttatttttatcttcatcataatttccctcatttttttctacaaaataataatcctctttctgttcaacaaattcactttttctccattttcctttctcattaaaaatttttacagccgacaaatcccttacttccaccatttcatctaaaacccacgcttctgtgccaattaagctgtcaaacctaacactaatatcattttcgcctacaattttttttctaaacttcacaagcgtataactcacaagactgttttcacctctatcaagaccaacaacatatatttcatttttgagaggctgtttttttagatagtcattaaaatttccaatcctatccttcacatcttttgacgattgatcgattgcttttgccactggattaaaaagtattccaaaatcccccaaaactttttcttctcggtatctcttcgcatcatttacaggactcatatctcgaatatatatccgcccttcaggctgtactctaaatttctcagtatcaaatttattgaagcaattctgccaatatatggtaaatagatttctaatcctttcactatttttttgcttggctacgaatctttctttcaatattaattgggcaaacttaatcctttttattctttctttatcattctcagaaatagcaaaatgttcatcaagttcaaaatctttattgaaaatctgatataaatcaatacttccttctctatctaatcctaaaaattcatcccaatctgcatcaatccattgattctcaaaacaataatcgtcaaaataggcttttatcccatcaagggttaccaatttatcaaaatcttccttattaaagcccgaagatatatttgtttttgacattatttcaaccaagtagttttttattattcccagatcaaaaacgtctcttttatctttttcattttttttctccagaattatcacacccttacaaaacttactccaataaccaacaacatccttgcttgtaccattaagtgacgaagtgggcaaaagacaaagcttttcaaccgctttccatgtcaaggattcatattttaaaagtttacaggaaaaaaggttattttttagattattaagaacatatttattatctgcttttagctttccattcgaaattttattttccaaggccaaataatagtttgcttctttttctataacaacaccaaaatgtgtatttttactattactaatggcagctttaagttgatttataacagcgtaattatttttctcattttcattatatgcaatttccttgctcaattcctttttcttaccctcacaactttcgtattctttttttgcatcttggtaattatcaggaagaccctgtttattttttatatccgcccacctaccatccgtacaatccttaccagctagattatcaaattttgaaagaaaactctgacattcagatttttctttcttattattctctaacttatccatttcttcctttaattttttttgtaaatctttctcattaaaaaaaacatcattaccagaaagctgagtattcggattttttgccttaaagtttaaggtaaacttaaaatggaaggctttagggttggtaatacaatttacctgcctaataatctcagcgacaacgctttcataatcattatccaaagctattattctaaaatcccctaaatccttaataaagacagaacaaccatcagatccatttttccctttatcacaaaagatattcattaaagaaaggatatccccgatacaatatgcaagacgctttaatcgatctaaaatttcaggctttgaaataaatttttcgaatcgattattatcatcaagaaaatcactaagttcaatttgaatacatttatatttttttataaagaaatttattttttctttcaaaagtctttgaaattcaccgtcttttgtcgttttatcataatgaaatgcaaataggtgacttactgttaaaaaatcaccaaattttacatgccgaaattctgccttattagtttttgcattaaattgatagtaataatcccagcctttccgactttttcccctttcattcttcatttgaaaatagcaatctctaaaatccttcccaactaacttcaacttacttgtttcaacatagatcctaaaattctcatatcttccatttatataaattccatctgtaatatttttaaatttttcaacaagaatatcaaaatcagatgtcaatttttgtaaatatctctgcaccaaatttgccacttcttgattctgagtattaaaaagatgaattatttcaatagtattgttttttacatcaataagaacagaatttcgttttattctcgcatctaaaactcttttttttgtatacaatgatggcttaaactcaaagttaatagtcttcctcaccgcatacaaattttgccaatcattcataattccaaattaaaaaataaatcaccccctcacaaaatcatcccacgccacattagaaacatacaaatccccccatgttattttcccgcaatcaccattttcctttgcaaagtccgaaatcttcttcaaaatcacaattcctttacgcgcaatattaaacgcgccattatcatcgccatttttaggcagttttttaccatcactatttctactatcaaaaaaaggttctacaggagataaaataatatcttgcttatccgagttcttttctttctcattagtattacggatttgacagacaagattaaacagaaaaataaatttcctgaaaaattcttcattacctttagtttcaagcctgtcaacctgccttaatatgtcaccagccgaagtattaaccccaaatttttgaaacaacgcctgataatcatccgtcaaatttttataataatcgtagccacccttattattatttagaatacgattccatcgccatcgctcaacacaagaacaaactgtccattcagtattttttggataagttttctgcccagaacgaaatttagtaatatcataagtaaactcaaatcgactactggtaaattcaatttgcgaaaatttcaaaatatccgctttcgctttttccgcaccggaatatttcagataaagatgaggtcgccaacctgtcaccggatctatttttgaagtataagatgcctgtgtataaaaaataatacctgtttgtttacccattttttggaatgtctcaaaaggcgccgccaactgataagcttttaacaaatatcctgccttttttgcatccttttcgcccttatccaccaaaaaattaagtttatcaattaatgctttttcgaactgctgataaacacttttttcaatccccccacgaatttgcttaaaacgcatatttaagtcttcaaatacaatgatagcattgtatttaacagccaaatcagccagttttcggacaacctgagaaatataacctttcttcaaatttttaattccttccacatcctgccaatccttgcgcgcctgctccctatttttagctttttcatgaagtttctcggcataattaacattaccaattgtatttagactatcgctctcaaggatatgcgccttctgattaatgaccgaataataagctaaatgcttttcaccacgatctacgccaatgatattaatatcaggattattagccaaaaaatcattaattttaacattaaattgtttcgggtcactttgcgttcgattcaacgtaagcggtacatgaaaaaagattttattttcggtatagcgattcttatgaaaagctttttctcctttattcaacgtaaccttgtttttatgagtaacaattttttgtttttccaaatttttcgttttaggacggtaaaaaatttctgcctgtccattaagctttaacggaaaattcgcagttatgttttcatctgaaaacaaaccttcaaaatagagcgtatgtagatttttagcaccctttgcgccttcattccaatccttatttctgatttgaaaaagatataactcaccattttggtttttttgtaaaatatactcctctgaaatatcctgaaaagcaacgttatagcttattctatcgatatcaccataaaattcatctaatgatcgataaacgtttgtttctttaaatgtatttaaatcaaaatcatttgtactttcatatttcgaaagaaaatttttacaaaaatcaatccaatcatgaagtgctgtttgataaccatttttatcatttgatagcctaaaatactctttctgaaaagctttaacaccatttttttcatcactcgtaatatgaaaaatatctgacttgtcataacgtatgttattgaggttaaaagtgcgcctcgaaatacaaagcggctcaataaaagctttcgtatttatttcaaaatcctcagtagaattatcaaaatgatttttcacagcttttaactgagtactacatttaggaatcatttttgcagcatcaggaagatatttataaaccactttctcatatttgcctgttttaatattattcgaaaattccgcaagatgcctgctatcaaaaatcttattattccctctactcatcaaacctaaataatattttccatcttttcgcaatagcacagcagaattatcagactccttatttttatcccaaccatcagccaatgttggattctcaaaattcaacttccatttttcctcactgtatggcttcttcgttaagtaattccttaacttgttatacatctgaacaatttcttcatatgcgttttcataaaactgcatataaccaaacgccggattatcataaaaatcgccggtttcatattcagtcagccactttcgcttcttttcaatcgcaaaatatttagccatctgataaatatgtaaaatttcatctgcaaactccttaataataactttattttttacatttaactcaaattcatctaataaatgcttcaatctttgcttaaaaacatcatagccaatttcttttttctcattcgtttcgatatcaataacttcacgaataaaaagcgattcaaactcaaagctaaaaatccttaaaaactgcggccaaacaagttcctttccactcaaaaaccctttacattcagaatctaccgaccccaaataataacgttccttccaaaatttcaagtctaccgacaagttttcaagactttcttttatacaggaaagcgctaaaaaatcaggaaaagaataaccaccatctttctttttagccgaagaagaaactattttccttttttttaatacatcatataaagcttcttcccatccgtctgtttcatttgtccatttacgagaaactgtattaaatgcttcctttgaaaaatagacttcagataaatcatatttatcgttattttttacaaaatctgcaaataatttttttattgagcctattttaatctcagcggatttataaaataatttcagcgattccaataaagctgctttatcctcaatttcatcaataaatttttctttttcacttaaaatttgtttatcaagattcttgaaaaaaggtaatttttcgtctgtttgctgtttatgaaggtttattaattcatttagtcctttttgtttttctccattatccaaagttttcccacctaatacagtattgtaaaaatctatcccgccctgtaacaaacattgattataaaattccaatgaaaaaatttcatcaaaagatctattataattcccctcgacgtccgaaaaatcaattttttgttttatgttttcataattatcaatattttcacaaaaacgtctcaaattttgatcaactattctagtcgcaatagccgttgaagtaccgttatctttgtaaaaattttttctcgtttcgaaaaatttcccaaaataccctgtaaaccctttccagctatcaaaaatagaaacctgttcccccgtgctttcatcaacaatctcagtctctttctcagaaccataacgcgctttaagcaaagcaaaaactccttcttcaaaaagcaactcaacatccttctttttcatattcaagtgcgcataatccaaagcccatttttgcgccataccatcaaaaaaagtgattacttcttttcgcagcttcatttctacattttccaattccttttgatataattttctatcctttcgccattttttgaatgattttaaataagccgaaagaccagacaaatgagcgtctgtgagcgcctcctttacaaattcccgatgaagacgatcaaaataaggttttgtctttttatattttttctgaatcgtctcatctttttcaaatacttttgcatcctcaagcatcttctgtgtcctccccaccggcttaagctcaaacctcaacgtcttcgaaagcgcatactgattagtaaactccttaaaatttgaactcatatatttaccgtttatagaatgaataaaaacatactaacaacagttatcacaattcacaacaaattaccccatccaccaagacaattttgctttatccaaaaaaaaatatagaatcaaacaaacataaaaccttatcacaaatgcccaccaaaccaaacctcctcatcccaacccccatctaccccccaatcatcggaggccccgccacctacagccacgaaatcgccacgcgcctcaaagacaaattcaacataaaaatcatagccttcgcc

SEQ ID NO: 301 - DNA, 17949 bp, Unknown
  metagenome-derived sequence
  misc_feature (1)..(17949): contig with Aux CRISPR spacer BLAST hit
  misc_feature (2896)..(2923): Aux CRISPR spacer BLAST hit
aaggaatggtgttcagaaaatacaagctcagcagcacaaaatcatgtgtgagcgacacattccacatcaacaagccagtcaataacggattcgagagcattgttatcaatccgtcgagcgaaaacatcaacgctggcgacatcttctatttctgcggaaagggaacattacagcttgtgaacgacgagatcatcttcaacaatgatgttcttgaaaaaggatataagttgcagtggtacaagaagaccaacggagtctggacctcgatcaaggacgcaacgaaagcggaagtggagatctcgacggctggactagaaaacagaagcgagttctacaagctcgaggtgagcctcacaagcgacggcaaactgtacaagcaggcgtcgaacgccatcgaggtgagaaacgtagcttctccgaaccttaacatacgcatttcaaacggcgatgtgtatttctgccacgcaggaaagagcgagttccagcttcagacaaacacatggagcagtccagacggagctgtagacgcaaagaacacatacacatggcagagaagctacgacggaagcacatggcaggatgttgtcgcaacatcaacggacaacctcaacatagagatagcgacaaaagaggatgtttcaacattgagctatacagaggagtcaatgacaaagccgacttatttcagagccgtgctgacagacctttgcggtgcgaaagccacttctaacactatcctcacaaagacatacagaggaatggatcttacatcaaaggatgtaaatgtgatgtctaacaagcttgtacagaacaaggacagctttgaagtcaagttctttgtcaactacagcgacgacaaggtatattcttacacttactacaatgaggacaaccaggttgtggagagcaaaggaacagcctcacagtcgttcgtacatgacactgagaacggagacagccacgctgatttcgactactcttttggaaagcacaaggtctatgtcgagaaggtgatgattgagaacggttgtaaaagcgacaaggttgaagtggagtacgagcttattgctcctttgaagattgagatccagaatggaattacaaaccaatgcccggacaatgataagcaattcggatatatgaacattgtctatatggacggaggtgttccagaaaaaggatttactgcgacatggtactacagatatgacgaccaggagtatttcaagaaagttgacgagacattaatcgacttcaaatataaattgatgtcaaatgaccaaggagagattgtaaatggaaaaatatacaacatcaacaatcttgaccgcacatgccatttctacgctgagatagccaatgagggttatccgatcaaggcagtgaagacttctgtcgtgacaatggagatcaaccctaaattcaagataggaagggctacttgcgacaaatcacagtattgctatggcgaggatgtgagactgacagctggcaacgtggagtcctctttcggtgatgtgacttacagatggattgacttgaacgacaagacagctatctacccatcgactgagatccttgatctggagtcgataaagggacagacgacattcagaagaatagcgactgacggatgcggaatcaaggacacattcgatgtggatcttgcagttcgtgacaaactcgaaatgagtgccgacgaatacgagcacgcaaattacgcagaaatgggcaaagtcccttatatcgctgtgaaggatcttcttcatgttgagtcttatgtcgtatcgcatatcaaccaggacggagtgaaggatgtgaaggaagaaaagacattcggtgtgacagatctgagcttcggaacaatgcctgctgtaggttatgtgatcgagagattcgagatatacaaggttgaccgcgctggatgtatgagcgtgcctgacactttcactgtcaaaggaattgagaagatcacagccggaacgatcgcattcgagcgttatggcgacactaaatcaatcaatatctgccatggcgagaagatcggtaggatcatcgacgacgagatcgcaagcggaggcacggacatcacctacaaatggatctacgctgaagtcggaaaggacgagaattatgtaagggattcggcaggtcttccgcttactacatcggtgttcgacgcagacacgacaaacttcggcacagtcgtggcaaagaacgttgctgtaggcaacaaggtcaagacaagctatgtcttcagacaggcgagcatcaatgtgatgcagccagacggaacttatacgccgtacatcaagaacagcgacactctttatatcaacgtcgctccacaactttcgaactgcaacattgagaaccttgcaggatctatacagacacaaagcaacgcatattgcggcggtgctgaagtgagcggtgccataaccctcactacagacgaggacgtgatcgagagatacgaggcgaaggatttcggtgctttgctgttcggtgaaggttatgagctttacggatattgggagccttcaaagggcggtcagaagaatttcgcccaggcttcttccgctgtgacttacgaggacggctttgaaagcaggttctatgccgaggatttcgattcgacaacttatgtgagattcgcaatcaatgacggatgttccgttttgggtactgattacaaagcccttaccgtaatctcattcgacaaggacagcactgacaactacacgatagaccgtcaggctgtggaggagagatacatcgagatcggcgacaatatcaaggtgactaacagggaaagcactatgtcgggcgaatggtactctaacaagaacgaaaagagtctaataagcgaggagaagactgtcacgcttgacagcgttacattcatgactcgcctgtaccataagagaataaagacaacaaaaggcacaacctgcattgagcctgaatattacgagataccgttgaacgtccacccagtgagcaagggaggtagaatcagaaacaaccagcaggtttgtcctggtgtcgagttcgaggacatcaagagctatgagaacgctttcggaggtactggagtgttccgctacagatgggagatcacaacagacagctcggatgcctacagctggagacagatagacaacgcatttgacgactctctgaactacgcaacattcagaagacagcttgatcaaaagaaaacaaactatatcagaagaaccgctacccctatctacaacgagaaggaagtgggagaggcgtacacacgctactccaatgtcatttcgcttgaaacatacaagactctgaaggcgtcttctctggcttggaatggagagggaaagaactcttactgttcggacgagagtgttccggctatcaaggctgacgctccgacaggtggatcagccgaatacaaggagtcgaagtatggtcttgactggatgtattctgtagacggaacaaactggaatctgtatgcttccacaagcgtggatttcggaggaacaagcgaaatctatggtagcggattggtgtactcttattttgaaggaaagaaaagggaccatgatgtcatattctatgtcaaggcggtgttcaaggatgacgagtgcggagaggtggagaccgatcctttctccttcaaggtatgggcagaaacagtggatccatcgctatatatcggagcagacagctgtgactcgaaatatataagcttcattgtcgagaatgacactgattattactacaactggacaatcggcacggattctgtaaatcctgtgaagactgacttcaaggagcagtacagaatggagtttgagcgtcatcctgcctacgtggtggaaagcggctacacagtccagggaatgcacaagctcagcggttgcaagacaagcattgtctacttcaatgtagacagtctgcctgaattgaagcaggagggtgttgccgaacaggacggcgtattgtgttacggatctgacttgaagatcagccacacagccgccactggaggaactggaacaaagagctacttgtggcagtactcgtatgataacgagaaatggagcgacgccaacgcaggattggatttcagttatgatgatgtgagaagcgacatgtatatcagaagactcgcattcacagacgtgtgccctgacacgatcgccactgatgcggtgctctacaaggtggctgacaagatagagcctatgaaggtcattatcgaggaaaatatgtgcaggaaccaggatatggtcgtgacacttgcggacagcatggtcggcaacttcaacgtggctgtctacagattgcagactgacacggtgatggagactgagcttactccagagaagctgacaggcaaaataaaagggaacgaacttgcggaaaacatcttcggaatcgtgacatgggacagctcatattcatgcaggtctgaaatggtcaagactacagttgttccacgccctgacttcgcagaatttgaaagctctatattgagcgacgatgaaaccgtatgtgagggaagttctgtgacaatcacgtctgctaccgactatactctgcctcaatacttgaagcagagatttgagacttcagcggacggcaaagtctggagcaccgttaaggaaaacagcgagttcaaggatgctgacaaggtcgttgcgaccgatactgcttactacagaactgttcttctcaacggatgcaaggacagcattgttagcaacatcataaaggttgacgttaaggagacgatagacaatcctatgacattcgaggtcgagacaaaatcagacggagagattgagatcatcggcaatggcaacactgaaatggctgcactctctcttcttgtgaacgatagtgtggagtatgatttcagcgagaagatcactcttgcgaaatcgacagagaaaatccttgtcgagtcaaaaatcggatctgacggaagcatggtctgctactcgcctgtgacaataaagccgttgaagggtggcaacatcttcactgagtgcaagtcgacaggtaagcagattgtcggcgaggatgttgtgaatgcaggttctgaagtgacatacaagtggttcaagttcggcaacgacaacacaatgatgtactttacggatgtgactgacaagaactattcgatcacagtggatgaagagaagagcctgatgctgcgtgtctcttactatgacactgacaacatcaagtatgttctgaaaagcaatgtccttacagtgaatgccaacggtccagcattgtcaaagatcgttcctttggagaaagattcaatgttggttgcaggtctgaaggtcaacgaccatttcatggagcttaacatcggcatggacgcaaccctaagctgtttcattgatgatgcgtcaaacggagagtggcagcagtctgaggacggtcttacatgggttacggctgacaagttcgattcaactcgcttggcttcacagacactggcgatcgagccttccgatgctgtctattacagggttgttgcgactaattcatgcggaacgacgacaagcgactcattacttgtcgctgttgaatcaatccctggaataacagaaggatgtcttgaactgacacttgacgactgtgagaagacagcgaccgtcatctgttatgacgacgagcagaaaaactacagaccaaaccattacgaatactactttgaggtgaatggagaatgctccaaaaaggagcttgttggcgagcacggaatctcactcagcggtatcagcggagaggtcgaggttcttatcacaagaagctacaagggtatcacgacaaagtatgtgaagaggattgacatgagcaagtccgtaggggcaggcttcagcattcttgcggaaggtgtggaatacggagcttctgatatggctggcgaatggcttggcgatgtacttgtcaccgacaaggcttcagttccgagcggaacaaagatcaagcttaacaacagaagcgagaacggaacttcttacaaatgggaggtatattacgagggcatcaaaatggcgacaagcctggtggagaatcctcagatctacgtctacaatgagggatcctattctttcttccttacagcttattcaggaaagtgtgagagcagcgtcaattgggagtctggcgtggaagtccagagcggaacattgagatatgcgaacatcgtcgaaccaggcgatttcgtgtatgaagcccagttccctgtttatccaagggaatacaagcacgtctatgacaacattgtcgtatatccgacaaagatagacaacgaagtcaatgtgatctgcaacggaccgttctcttattcagtgtacaacgcttccggaatgctgatggtcgagggggagggcaaggaccaaacgactatcaactccgaaaggctcaatccaggagtatatacagttgttgtaaacggatcaacgttctcaataattaaataatatctaaatttaacatatttttgttgattaagggaagagggctgtgaagctcgcttcccttgcttttttcctatcatgctatgaattggacatacgaagaaagatggagaagtcggatgtggtaaggaactttgtcttcaaggaaatcatgacaaaacaatacgaggagtctcccacattgtttgactaacacggtaaatttggatttcatctgccattttgtcatattgctttcagaataagcacatatttattgaatggcatactctttgtttctatacaaatgtgaagcaatggagcctcacataaaataattttatatgaaaaaaagatacgaagaccccgattttgagagttttgttgaagaacttttaagagtagaacgtttgaacgaaaaggaggctggtatagccaagcaaatgttggatcaaggatacgacagtttgagtgataaacaaaagtatgtctttgataaagcaatagaaaacaacagtgtgaaagaatgtaaaaggtgtagttccgatattccatggtgtgaaatgatagaagcattagacaatggaggtctttgcggctggtgccaacattttaaggagaaaattgatgaagaataaaatgtcctatgacaaagatttttgaaatttatgatgcaaatcctgccgctgcatactacataatgtcgatgattgcaggaagatgtgccgggatgcaagaagatccagatggagaagattggaccaaatatgataacattgatatttccattgtaaaaagtacgaaaggtattgagaatggagcttttgagaatcataatcaggtcggagatttgcggtgggagtacactgtaatggaatttgcagacgattacaattcacaagagtgtcttcttgacattgatgatatagggcacgaaataagtagacttcctatagggagatcatatttccattactacataaaagcggaattattcgtagaagcaaagtaaatgaattggctaaagaaaagtcgttgcgtatggtagcgactttttttgatttaaaaattataaaaaaggagcaaaaacatgaatgttttgttaatcaatactatttttgtaatgtcaggaaaaggattacaagtattgccttgtctacgacaaaagaagcagtcaaaagtcttcataaaatttaagatctctaatcatatacttacaacagaaatctattagctctttatttggaaatgatgcaaaattgaaatgagtactttctataggatgtgtggattcaatctgagaactatatacatttacagaatatgcaccatatattgttccccaaatttcattatgaaaataacctctatgatgatatacttttaatgtatagtgattgtctgcactgctaccttgacatactttcacgcgattgaattcgttatcttctgccatttctacttctgatttatcatgatatcctaggcaaacaattccagctttctttatttttctaaagttttgagactgtactgatactactatcataaatagtacgaaaaaaataaaagttgatcttgatataaatgaaagtttcatatgtgatatgggtcgttatggtcgttcttaaggaattataatcatggcacaaagttaagaataattcttattaatctatattttttttctttttacttggtattttactttgtcgaatggaaaggaatggacgttaagatagaggaatgattagaggaaaaaaggaaagaagacggcacatagccttttgcagattggacctttttcgtaactttggtcttgaaatcaagaagtaatggaagtaaaaacaaataaaaatgcaacttaaaagttgcatttttcgcaaaatattactacctttgcatagaaaaaaagaaatagaatatgagatttgtacaaatcataccaggttataatcatttgtgggcagtaaaggaggaagaaaaggagacagacgagttgtcattgcttttccgtcaatggagcaacttcaactatcttctcgacttctttttcgccaaccttgaagacctaaaaggattcttccacatagaaaaggtaagcgatgccataaatgacacaatggaggatgcccaggagttggagcgactgatacttgactttccctatacggaacagcttgacggattgttccatccattaagcttatccgacgacagagcacatgaactgacacgagagaaagcgaggaattggggaagaagacagcatccaagttggctgcgtatctatgctatacgaatagaaccaaatgtatatatagtgactggaggtgcaataaaattgactgccaccatgcaggagcgagaacatacgcagaaggaacttgacaagctcaacatctgccgggactatctaaaacgtaatggaatatttgatcaagacagttttatagatttctttaaggaggactgaatatgaaacaaaagacattggaatttttggtgtctcataagagtgagactccatcaacatttatagaagatgctgcatggcgacaagaaaacgaggtatggctaaagtggtcacgaaaaatagccatgaagatagttgactatatgcaggagaacggactatccagatcggatatagcagccaaactgggagtgtcgccacagtatgtaagccgtattctatcaggcaagacaaatttttcatttaaaagcatagcggagatagaaagaaagcttggaatctcctgcatggaagtaacaatggcatgataaacaaatggagacataaaagaatctgaattgtgaatagaaacaaaagtaggcgacttgttaagtcgtctactttttgaatggttgccttatttttttgattcttctaaggattccttgcgaaactccttcataagtttctctagttctaaactggcttttctcgctcttgttccagctgctttatttcctgattcaatctgagaagcagcatcttttaggaatgcttccatagtggcattgatcttttctacaatttctttcatatatatttttatttgattgttacaaagatataaaataagaggaaaaagagaagtattccgaaaaagaagtcatattttattctccttcctccaacataccttgattgcgtaatacattctgtcgaatgttccatagtctcttgtatggctgcaccccttgatcagcaagttccttcattctgtcaagttctgcagtgcaaatattttcagcctctcgacggatgcagtcacgattgttttgaagatattccctcatgcggttgtctctgatctcgcagactttattgaatagttcatctttcgccaaatatacagggaagacatctttcatctttttggaaggttttctcacctttctgataagggttgaaagagtcttatatttatgatggtcaaaacctttttctgcaatgttgttacgatcaaaccagtgacgaagcatagcattaacaagctcattagtagttttgaatttggaatgatcaaatttgatttgatcggcatagtcacgaagattttcatccaccacatcatcgtcgaaattgtaagtctcaggtaattcaagataatgagattcctcctcgttacaagcctggacatcaatgtctatatctgcagagaaaactctgtccggattatcagtgccgttgttgtcacaaacaagtcctgcaaaccatccttgtccagcctgtgcgaatctttctggtggaaccatatagtccatctgatcagaaatagaaatagatgttccattctctgatattgagattgattctttctgctgtttgttctttcctattcgtttagaaattttttctgcagtctcgtcgaaacattgaccaacaaagatattaccaactgtctgaattattttgtttgcgtttgcttctttatactcagctttaagctgagtgaagtcttggaatccaagaagaacagcgacctcgttagatcgagcggtagcaatcaactcgtcaagtccatgcacgaacattgttggaagctcgtcgatgacaactgcacatttatgttttcctttattgttagccatcttcagcattctggcagtataaactcctaaagctgtaccatatacctgtgtcttctgaggatcgttgccaaaacaaagtaatttgggttcaagcggattgttaatgtcaatatcaatgtcatcgccggacattgcccaatatagaaagatggatgcaagtcgaccaagcggaatctgtacggaagcaatctgaccttgaatctgatctgtagcaccagcggaccaggcattaaggaaaggtgcgagtgtaatactaagatcactgtagctggcaagaattggaatcacctcgtccataggctgagaaataaagtcgattacatgaggaaatgtgcaatatttgccatcttcataaagacgtaaaaaccagatacaagcaccaaggtagttgatagctgactcaacaaagaaatctccctgcttgtctgcccaagtgtgagccaaattgtaacaaataacctgtgcaatctgattggcgtcttcctgggattcgagaagctcggctttcagaggattacagcgaagggaaactctcggctcattgaagtcaaccattccatattttggctctaccccaccatatatctctttccagcgatccttgttccacatgaagtttgaaaatgcaagttctgaaagatcaggtatcttgaaatcataaaggtacatagcgaatccttttgcaagtgcctgacggatatagttgtttatgattgtgaaagattttcctgctccaggcgttccaagtacgatagtcgcacggaaaggagcttcaagattgatccatccatggtgttcctttcccaatctataatatcttgtaggaaagttaattgtgtattggtccgttttgaatttttcgttctgaggaaaagccgactgctctttcttattgaacggatcttctctcgatagatttcgttctggagttgccgtatagatcgccaaaccataaatgaatggaagtattcccatcgcaagaagaacaatgtagaagaataatcttggaatagtgacagggataaacaatgctactggggcgataagtgtgatgatcagaccgacagcagacaccttcattcccaattcatgagtcggcacaaatgttctgccaaaaaatttcttttcgtttgtcttgacagctttgtctccgatgcttgcaccgaagaacgccagcaaggcaggaatgatggtcgcataaggagaatgcagaagatatagagctttgttcaatcctgccaaaatgttaaaccatgcctgtgtgatcaccgcatacatgcctgttgcggatgtgtcatgttctaaacagaaccaatacacgttcaatgcaagtaatcccattcctactgttttgaagagattaaggaattttcttgctgcttcctgattttctttcatgttaatattgttttttattatttatactgtttaccgcaagaagtaagcatgggttacacacccatacccttcttcttgtcttgattattcgattgtgtcttgtcttgacccttattttctttgcccttctgatatatttttgttctatggtagaatccgacttctttgtccttctgatattgtgaatagcttatgaatgacaaatccttctcagcatagtgcatcagatggtcaatgatatgtgatgtgtcaccttcattgatcatacgtctgatgtcgttcgacaactctggattgtgctgcgccatccaatcacatatatatatgagtctttcctgttgtttgaaatcagattcaagaactctgttgaatttctgaaccgcctggtaaagcaatgtaggataacctctcttggtcaagaacagattgttcatagaaagaagttcctctttatggttgatgaaataatccctaaacttagagtctgtgacaaccaaagaagctgatgaatttggagagaatatgatgacatcatcccccctcatttcaaacagcataccactcattatcatcttatctacagcttctgttatagaattgttctctatcaagttggcaatcttgtcttgcatcatcttagactgagccctggtcttgtcattctcagacaggaatctgaacagcttgtcgttaagattgaagaagtcaaatttgattttttcaattcctacatcatgcacgagtgtatagaagtccatttctctttgagtcaatggcttatcgtcctcacgtcgacgagcattagtaaatacagggaaagagattcctgtattttcaatgaagaagtctgatctgcgagaatcacacagtttgccatcctcataattaaacactgatgatcgaagaaggtcatcaagtttttcaggatccacaactgctgcaatcttcaagaactgagcaacgtcctctctgaatgtctgttcctctttcttatagatggaatttagatccctattcttatcttcaaggaacttctctattgcgaaacgtgcgttgtattcgttagcatgatagaactctttacaataagagatatacagatctgtttcgtaaggaaggaatctgatagcgttggactcaaattcatattgctctttgactcttctctgaagcatatcttcaagtgctttctgaagacggttagtttcaaagatctctggtgactctcctactccaccagcaataagcctgtctttaagctccttcgacagatttctgtcaacctcactggctttgtacgaatatcctctgccatggtcaacaaagttgaatcctataagcaaaccaaaatcgttaatcagaggctgtgcgtcaataccatgtttcttgacttctgcaatataatctccgtaggtaattttaccagcatatttcttgaatatgtagtctgtcgcattacggacgtgtttcttagacacattaacctgattcttacggcgatcaaacaattcctcgttacgtgagaattgatccttccatgtcttgtaagaaaacaagaacttgctacctgcaatggcttttccgtttctttttccgttctcgtcaatcgaataaaaggaaactccttcgtattcgttacttacttcagatcttattccataagaagcaagtattctgttaagctgactaaaatcagtgaactcatagtcattacgtaccttccgcaatactctttgaatattgtttttgtagtctgaattaggaatgtcgttctgaaggaaagatgtcttgtcaacaaaattgattgcgttagcgacacgttgctttgcctgctcacgataatccttgctcttttcaggagaagaaaggttgtatttttgctccaggctcttacggatttccgatgtttttcggtactggaagctatcgtcgatacacttcttacctttcttgtcaatgtctattgaaacaatatggacatgggtatggtcagtgtcctggtgcttgacaacaaaataaggttggttagcatagcccatttccttcatgtaatcgtcagacagacgggtcaatgtatcatcagacaggtctttttcttctggggatataactccatggaagacgtatttttccacttttgaagtaaatcctttcaatggcgttgcgatatgtcgcatcattctctcgagaagaggtagattattcaggtcatcaacaggcaaattgtgggctgaaagcacagtcgcacggtcgtcattcaccttttgggtgttataacgaatggcagctttcaagtccgaacctttgataactttgataatcatagcctgaaatttttgattttagtccctatcgtcctgataaagtttgtttatgtaatcgacataagccttttggatcgcctttgttttttggtccaattccttttgaagatccattattcggggtaaatactccagcatcttggttacattgtacccaagaattgcgtcctttcggctttcgttaaggtgtcttgccatctggttgacgttgacggcgataccttcaatctgtttttttacggatataagctcattcagaatgtcatctgcaccgaatattggaagctgtacaatcttagtgttgtgcagcaaatggcagatgtattcggactttgttctgaagttggatttttcaaaacaagtcagaaagtcgtttagttgactttcattcagtctgacgttgagcctgtaggtcttttctgtaccaggcataatgaaacttttttattaaaaaattgtaataagatccgcctcttggcgaattgaaaaaaatgcgacttgggagcatttttaaggacaaaaattcaaaattttagaagtctaaattttgaatttttgcgatgcgttttgaagttcttttgtgaaccaaaacgcacatcttgctcacgcatccatctgcgtgcaaagatagtgaaaatttttggatttatcgaactcttttttttgttaaaaagagcaaaaatttgaaacaataaaacttattggttagtagaggtgatttgctgttatatcaggaaataacctctacactcttgtggtgaaaagatgtaaatgaagaaagagaaatctagaactggagaaaaaagaggggaaatgagccgttttaagggtgaatctggacggtttctttgtgcgaaggtacaagtgtccccaaaaaaacagaaaagacggcttaaaacgcaaagaaatggttggtttttagaaagaaaaatgcaagaaaaaaatgggtaaatagctgtaattatgcgtgatatataagcatatagggtaaaagagtaaatatgtattaaaatgcgtaataagatgtgatataaggtaaatgggtaatatagtaataatatgttatagtatgtaattatgggttatatggtgtaataatgcgtaatagtggataataatgtaaatatgggtaaatatacgtaatataatactatagtgtaatatattgtaactatgcgtaactatatataattatacttaatattatgtaaaaatgggtaatattgggtaatatgttactatggtgtaaaatgtagtaatataaagtaatattatgtaaatataattaactatgtgtaattatggataaaggtgtaatattgggtaaataagggtaattaatactaagatgtaatgatgggtaaatatctgtaattataagtactatgatgtaactttcagtaaataagggtgattatatgtaaatgaatgtaaatatgtgtaatttgtagtaattttaagtaatatagtaataggtagtaaaatgcagtaatataacgtaattatctgtaattagttgtagtaatgcgtaatatgtagtaaaaaataaaccgttttcctttgaaagaaaaaataaatgaagtatctttgtgagaggattagaaaatccgtatcatttacaattgtactttaataaaaaagacctatgacaaaaattatttcttttgtcgcccaaaagggtggctctggtaagtcgactatgacattgataatggcgaattatttcgcctacaatgaaaaaaagaacgtcgtcgtaatagatggagacgctcctcagtattctttgtataagcttcgtaattcggaggaagaagacgaagaaagcattaacaaaaaagtactttcttcccacgtaaaatcagatgtggaaacatatccgatctatcaatgtgttccatccgaggatcaggaacagccaaagaaaaacatttattcggtaaacaaaataattgatgcccttgttcaacaagggaacattgattacatattcattgatcttgcaggaacattaaattcgcctgaaatcatcgaaattctaaaaaaggtgaattacatctttattccatttatggaggcatcaaacctttatttctctaattatgaagctctgtacatcgtcaacttgatagctaagaactcggaaaatgcgataaagggtgtatatgagttctggcacaagtacaggactcaaatgagtgtccgaatattctatgagctggcagaaaaatttgacattattaacgagagtcttaaaaaaactggtatcaacgcatcgatgatgcagtctaagattggaaattccacaaaagctttctcaccagaaatatggaacacaattgctccgatacctgacaattatttgtcagtgttacctaacggactaaaccttggtaacttcatcaaagagtttaaaaatttgattaaataatatcttatgggtattttaaaaaaaggagaagacaaaaaaaagcttgccttcaataatctcatgaccgctgtaagcggtatgaatccgaacaagattaaacatctgacagaagatgatctgaatgatccagaaccgctttccttatcagagggaagagaaaagaaagaggaggaggtcaaggagtcttccgaaccagataaaaaggaggatcaagaagcctctgcaagatcagaagcagaggagaaaaaggagcaactttcttcttcaaaggaaaatgaaaagaaagaagaggaggtcaaggagtcttccgaaccagataaaaaggaggatcaagaagcccctgcaagatcagaagcagaggagaaaaaggagcaactttcttcttcaaaggaaacacaagatgtacagagtcctttttcttacgagaatatcataagaaaatccaatatagaagatggtcaattcaccaccttcaaattaaaaagagaaacattagatatgttggatgccatcgcaagaggaagcgaaaaaaacgtttccaaatcaacaataatccacaatttggtatcgactttcttgactgagaatttggaaaaattgaaagcagtagcggcgaaaaaaataaaaagagattacttaaaataatatcttatatattttttaaactgattgatttttagtaaatttgtatgtgttaatctctgacgagaaaacgcaaaatattacaatttaactatgtaagcaatggaaacatggagttggggggattttctctccgtctggattcctttctgtatagccctcgacatctttttcgttgtaatggataaattcaactcaaagacaacatcctcccaggaggatgaaaggaagaggaaaacaaagtccttgaatacacaattcaaggatgatgtcacatataatatggcatcgaaaaatttatccatgcgaacagtcgaacttcttcagccaaaaacaaatacggaagatcgtcttccacaagcctcagaagtagagggagaggaaattgattcaatcaagaaagaacaggaatcaaatgaagctaaattggtacgtttgtacaatttgcgaaaaaaagagaacaaataaaattataaactttaataaaaaagaacatgaaaagtttaaattcgagagtgagagctctaatggtagcagtgtttgtgtttgtattcaatagtctacttgcacaaaaaaatgttgg

SEQ ID NO: 302 - DNA, 6138 bp, Unknown
  metagenome-derived sequence
  misc_feature (1)..(6138): Contig with Unk15 CRISPR spacer BLAST hit
  misc_feature (5486)..(5513): Unk15 CRISPR spacer BLAST hit
tgagcccggatattttgtgccttctactccagtgaacgctgcattagttactacttgcgcttcttttgaaccgccaataacattctcagcagccaaagtagtcttgccagatgctgcaggattccccatcactctttgagtatattgtaactgtgactcaccaggcagcggtttactgtaagatactttcacattttccaagaatgcttttgggtgtggtttccttagagtgaatttcttgggcaatgattcactgccgccgggaatatcacttaaataacctgtatataactgcgtattgccgttcttagttggaactgacctatagaaatgtaactcgtcagcagcttttcgcatccctgaagcctgctcaggaaaagctcgtaattgtatctcattacctgtttttttaacaaacttattgaacgcaggagactctgtcacatgtgctgttttaatcttcttattggctactcttttgattaattctccccgcgatattttctctgacatagggtcattagctacacgtgcaacgattgtttttctggttgacccgccaacattgttaacgttcttatcagcagctgcaagagcatcagctacgcctgcagtagggtcttgagctataggaacataatttttgctgcgtttgcctattgatgttgctattttgttcttaagcaaagataatcgcggagcaacagctgctgaagccgcctcagttaagtcagttcccgccataaaacctatcgctttcgttacttgcaccccttgattaggattatttttaataaattcctcgctcatgcggtccatagaagcataagggtgagtaacagtgttatatgctgatatagttgttttaatagggtgtcttattgtttgatatgctcctattggaacagataataaagcgttgcctgctgaatctgcagctattaacccagtgttaacaattcccgaaacatcagttaaagctagtcttgtcatactacctttaggaccatattgccctaaattgacataataattagttaaatctttatcccgattcttaggtgcatatgcttgatcgaatgcttttgttcttgctgcagccagtttttgttctgattttgtcagtttaactgaaggtccaatcgttggctgagggattggagcattataaatcatattgtttttctttattgctgttgaatctgtccatgcagccttatttattatattcttctttaaaatgggcgcaggttttgggatggttattttctttttaggttgattagttttatttaatataggagtaaaaacttgtggataataagaagaagaatattgcggattcgtggatgatgatgatgatgaagatgatgttataggttttgtttgattggttgttttctgtttggtggttttcttttttgaatggaaatatttgtattccggagaattcattgaatatgacatttggtttttctgttctaaatctgataaagatttcgcggtatacattgaataatccattttatttctgattatgggaatataattttttaaaacttccgattacgtaaaaaaaagttatttaaatgaacaaaaccaaaaagataacaatatctaattttttaaagaggtgaacaatgaaactgaaaagtataaggaaccttttaggttttaagaagaaaaggaaaggactggctgtcatggacagttttattgatgtttttgttgggatcattgtgattgttgttttggtagtccttggttcaacaatctctggtgttatgttccagaatgcatcgggaaccattgatacgattcaaaacgccacaataaaaaactcagtaacatccgcagcagggaactcatttgcagcgcttcagtccagcactaactacattaacatattagttcttgcaataatcatgctattaatcatgggaatgattatggcaataagagcaagcacaactagacagggaccaagaaatgagactatgttgtaggagtaaataagttttttttattttcttttttctgaataaaaaaaacataattttataggggatataaaatgaaactaaagaacattaaaaatttcttaggttttaaaagaaagaaaaatggacttagtgtcatggacagttttattgatgtttttgtcggtattattgtaattgtcgtgttggttgttctagggtcaaccatctctggtgttatgttccagaacgcatcgggaaccatagccactattgctaataacacaacaagggacacaataaatgccgcagcagggaatgcgtttggagcacttcagtccagcactaactacattaatatattagttcttgcaataatcatgctattaatcatgggaatgattatggcaataagagcaagcacaactagacagggaccacgaaacgagactgtgttgtaagagtaaataagttttttttattttcttttttctgagttttttgtgttatattttagaagattatatttgagtttagttctatcatttatcttaagaataagttttatatcgtcagggttattcaataaatcttttgttattgctgaaacctctttaaaagatgagataaacttctggaacctataatagacctgaccgaactggtcttgacctatatttaagtttatctcaattgttgtcattattaatcatctatccctatctgtagataagcatcataagctatagctacactctcttgtaaccgttccgtgtcaggagcagccgcagagagaatctcttttttgaactgtttgagtttatctttatctttattgcttacgtgaagatatctcttatcgaaagcctcgacgtggaacatgagagaattaaactttactttgatatcctgtgttagattcactgcagctgtttttagttcgttattgtctttgccttctttttctaatctcattacttcatgagctacgtactcataagttgaagagagtttaatcaactcttcaatttcattaaacaagatctcgattactttctgttttgcattaatgatttcatcaggcatttatatcacctttggcactgttgaattgactacatgagctgcaggggggactgcagcctgaactgttgtttggaacgttctgataatgtttggcaagaacagaactcctaagattcctacaattatcaataacaaaatccagccccaattccttatgaatttggacgctgaaccaccttgtaataaatccataacgtgtcgagagaaaggttttaatgacaagattaattgctcttgatgagccaataaattggcaatcgcatgacgtgttgtgagttttgtttcaaaatcagataatgcctctttggacagcatcatattagaaatagaatcatatacaaagaatggtttgtttgataccttatacatgcctttcaataattcatcgtttttaatggtcaatatggtcttctggtcttcttgttttttgctgtatgatttattctcaaaaactaaattgtgtgctaggtctctgttgtatatatgagatttgtcatgtttgcccagtttgaaatgaagccgttggttggcatcaactgttgctggaatgatcttccatatgcctgtagaggatatgttcagaataaaggggtttgggtcctcttctaacattgaaaaagcagtggttgacattttcttagcaagaaaaattactaataatcctgttagaataaatgcaaaccccgcataaaccagattaaatgtaaacaaaaaagtcacaacgccaataagcatgggcagaaaagcagcaatcagataagacatataccttttcatcaatattggattcattattaatcaccttttattagatttatcttcagcagtgcggagagttactcctttttctgccattttgttaaatgcccagccttcgattgataagccagaccttagaatgaataaataaatatcggacatgaattttgtgccgctcaggcagcaatgcatggcacgttctaatagtttttctatgtcttcagtttcagaatcaatacgagcatgtgtggtgttgtaatccaaacccagattctttctttcttcgtcaataaaatcataatattcatcggttagagatacaaaatccctcagccatacaaagaactttcccaggatatatctatccctcagggatagcctggtcatttttaattctgtggctgttaacagatataacaattcagacaaatcctcttttgatagctcgtctttgcgcattaagaatttgattctattaatgaggtcttttatcatgaactgatcgatgtttttttcgttagattcaacaccgttcataatattattgaaagtctgatactgttccggttccatttttataacctatatttctttttaagataagccatttgttttttggtttccaaatatcgccacataccgtaacccattatacctatagaagcccagactatccctactgaaccaacaaacccaatagctatcatgataatcgcatcaactaacattcgcttatctctcatgataacctcatgcgcagcatctctttttgtgatggtttcctcttttggtttcggtttggggtcaatctcatttgactccaatattattttttcttccattttttagttcaccttcatagataatttttttagttcctcatcttttttagtcttatcgcgcatgtatcttccaacactacgtatattttttctgcctgtccaatatagaaattcttgaattgttgcaactttgccaagcttacgtaatctgttatgcataaaccaaatggggattaaatcataacctgctgccctgctccatttcttaatataatcatgaaccttttttgatttggttgtgtaagttctaatctcgccgcttttcagtttaatttttattttataatttgagatgaaatcatggaacaagacaaaataagggggtttgttcttaatatattctgcaacttcgcgcaggtcaccttcgtttttgaacactaatgtggttttttgtttaatattaactttaatatattgagatgaaatctcaaaatcgcttgaaagcaatgacagaatctcacttgtttttcgtcccagataatataacaaaataactaaacttctggcttcaggcatgtttttatgtttaacacgtcttaaaatagcatgcaattgcggtagtccgaatgttttgatttcacctgtttttctcatttctgagaaataggggttgttaaggtgtgccattttatatcactaaatcaatagggttagcttggctgccccacatattggataataataaacgaattctataattgctcattctgattgttttctgctccttctttgctgcatcagtataattatctttcagtttttcgtctaattcttttttaaacgtattaactttattgatgtattcatcaacatcttttattgcggatttgctcaatgcaacgttctctaataaatctacaaaaaaagtgagtgatttaaagttttgagttttgcccgcttcgacataatgtctcaataaaaaagaagcaaaactatcaaaatcaaaattaagtgcatgttcgaatatctcttcggtatcatcagggttttcttcattcttgaatattactttcttgttcttcatgattatcatcttctttatgggggataatataacccagctgagttagtctgtccgttaaaaggtgttcaagctctcgcgtctcatcattgcttagctcatgcattgattgaatatctttttttattacgattttttttctcctttttttgaggatgtaatttaagttttcggggtgcgctgtatagaactctacaatcttgtttagctttttattattgtctccgtaaacttctttggataattccttaaagaatctgtctaatttagttttaatgattttagatttatataattttgataaataatcatacttttttcgtattgctttatccactaaagtgacttcaatattgcggattcgcacatgttcccatatcccattgtgtttgatataaccccttatcgttgcctttttttgtttaattgcttcgaggttgtgatcatcagt

SEQ ID NO: 303 - DNA, 2722 bp, Unknown
  metagenome-derived sequence
  misc_feature (1)..(2722): contig with Unk15 CRISPR spacer BLAST hit
  misc_feature (1971)..(1999): Unk15 CRISPR spacer BLAST hit
aacgttcctgcagtgagtgtcccaggtattataggcgcagtgactcattcagatttcacgggtaagtatgcactgacaggcggcatattgagacaacttcaccctcatggtctggcagtattggacgaaatcaatcgcggtcgagatattgattatttgcacagtaaccttctctctgttttgtctgaaaaacagctcaatatccataaagcagggataagcagagaattcccgtgcgatattaatgtccatgccacagccaaccctcaggacaaagacaactttgacgaaaaaaaaccttggaagagttttggcatcacacaagagttatgggggaggttttcgtttaaagtttatttctatagcactgtgaatttcaatgattcaaaagaaatgtataaacacgttaatcttaaaattgaagaaaaaaacacaaaatcatctcaaaaaaaagagttaaataaaacaatacaattgtttaagaaatatcaagtttatgcctggaataagattaagaaagtaacctttactgacaagattaaacataaaatcgcagatgttgcctcactgaaatatttcaattcagaggtgacttggcccagccaaaagagaactacaatgggaattctgaatctggttgcagctatagctagaatcaatttaagggaagttccgaatgattctgatttgcaagttgtggttaatttattggaatatattgcaaaatcccgcgatgaatatatagcttacaaaaaagaaggaaaatttgattaaaaaacaaaaaaaggtgatataaatgaaccaaaaccaaagaataacatctgacgtagctattacatctaataggatgtataataggataatacactcaccgcagagcagtcaaaaaaggaaactgcgcaagctgtgtgatgacctggctatgtcatatgatgattttgattatattagagaattaaacaaaatcataacggctcagtatgatgcattaattgaattaatacccactcctgcagagataagttttttaatatataagatgagtgattcatattattatgataaacacactaatgatagaattcgcagtcttaagagactgctcagaatatctaaattgactatgacaggtcacaaaataaggatatcaagctatgatgagcaagttaagaggcataaaaatataaataaataaaattatttataaataaaactatatacaattaatagaaacatttaaatagtttctatatttacaataatataaaacaagtttaaacttgtttaaacgaggcaattaagatggaaaaaggcgcaaaaaaagttaagataatttctttaaatggaaacagcaaactgataaatgcatgtaagaaggcgggcttaccactgcataatccgcaaggagaatggaacggttatgggtataagagactacctttagcggttactctttcaagtttaaaagaagtcagaaagtttaataaaataaaaagggaattaaacaaaatccccaccaaaaaacccaaaactcctgaagaaatcagagagaaatgggcaaaaaggcttgtcaagttaacaggcatttcaatggaagacgcattagagatagcaattgaaaaagaagactataaacaagaacaaatctatgatctcgaggagaggcagattgaccattatagcaaacgcaggcagactcttataaaccaaatcacaagaagtaatccattaagatatattaaggattctaaccatgcacataatatcttagctgcgcaccacaggcacagcgagaccaattatgagaacttgcttgatgaaggcagagagttggctgcagaaggtcagattgcaaggtcagaagttaaggattatgcacgacagagcgtgcagttataaaccaaaaggaggcaaacaaaatgggaatagatctaaagagccaatgtaatcaagaaataaaaaagcatttagatgaaatctatagtcatgttttgttaagagatttttttgatagtgatgatgatgaagataatcctgagaaaatctctaaagaaaacgaagagaaatttaatgaaatagatacaaaattaaaccgattacttagagatgatgctcatcataggaatttatatatcttatatttaattaaactgctattaggggatgataattacgattaataagaattaaatatatgaaatataaaattaatttaattttagataatgaatttgaaaaaatcaatgagatgataaaaaatgaaagcaaaaaaaatcaaaaatcacagaaatagaacgaggatgagtcctggactcatccccagaaggcaatctaatggtttttgggcgtttctatcaatatgataacttactcatatttaagtattttgatttttctattctttaagaatataaactcctcaaacccgcaattatcaggcagcatatgtttttctttcaaattcttatagtattcactatccttaaaatcattagtaagaatcttaacgaaagtcaagcctttgtcttttgatgctataaaattaaaatccgcagccaggctgcttggtttgatttcacttaatgtttcagaatattgtgcggttagaggcaggaacaaacccacgtgatacccgcgtttaacgtaattgtttaatacggttttcagtttgctttttctcattttttataccctttggttattgctgcaatagcctggatga

SEQ ID NO: 304 - DNA, 6165 bp, Unknown
  metagenome-derived sequence
  misc_feature (1)..(6165): contig with two Unk19 CRISPR spacer BLAST hits
  misc_feature (4823)..(4850): Unk19 CRISPR spacer BLAST hit
  misc_feature (5831)..(5859): Unk19 CRISPR spacer BLAST hit
ggcggcgggcacattcacgcgggatgatgttggcggttcatggattacagacggcttcaaggtaggggacgtggtgcgattttctggattcacggccacggcnaacaanagccanaacttcntgattactgcacttaccgctactgttatgaccggaatcatgcttgatggcgtggcggttgttgacgaggcgaagggccagtccattacgacaacagttgtaggaaagaagacttggactcctgcgaccgcacataccgagaattggtttgccgttgagcataattattccgatgttgacctgtccgaggtgttttatgacctcaaagtaaacagtatggccataaaactaccggcgactgggcttgcaaccgttgacttcggccttatggggctgaattatgtcaactatgcttctgcctcgtcaccgtatttttcagcggttatggctgtggctaccggcggcgttctggcggctgtcaatggcgcgctgtatgttcaggggacgaaggttgcgcttctgaccggtctggactttgatgtggccggaaacctctccagcgaagccgtggtgggttccaatgtcaagccggacatcttcgatggccgtgtggccgtaaaaggcaacatgaccgtattctttgaagacgcgactttccgcgactacttcttgaatgaaaccgaagtgtctattaactgcgtgtttacgacagggacgggagcgaccgcggactttattgcctttaccatgccccgcgttaaggtcggcggcgcgtcaaaggacgatggcgaaaaaggactggttcagaccatgccgtttaccgcactattcaatactgcgggcgatgatggtacgaccaacactgtaacatctctggcgacaaccctgagtattcaggattcaaaggcttaatcattaacagggggcgggggaaaatgcatccaaaattagttaaatcaataacggaatatcttcaaagtgttcttgattttgatccgatgatcaacccacaaaagatgggacaatgtctgtattgcggtgttgcccttgatgaaggtaaaaaacatcgcccagattgtcattatcttgaagctgaaaagcttttgaaagaatttaaaacgaatgaataaaaggaggcaaacaaatgaaagaacgagtagaaaagacaatagaccttgcggcactggataccgtaaaaggcagtaacgccggttttgaagtgtccatttacaatccggcaacccacgaggatttaggcttgttcattaaagtactcggcaaggactcagacgagttccaaaaagtatccagggcgcagcagaaaaagcgtattgagcaaatgagtaagggcgggttcagaaacactaacgtgccgattgaatccgtcgaagcggatggcatacaactgctggcaactgtaacaaaatcatggcggcagggcgaaaagcagacacttacagtagagggcaaggaactgccatgcacgaaggacaatgcagttatactctatgagcggttcccgtggattaaagaacaggtagatacggcagttggtgaccgcgcaaattttatcaaaacctgattgattcgcttgtcgagtatgccgagcatgagtttaaacttaatgccaggcagaaagacggcgcgacattgagggatcatcttgagagtgtttataggcagacaggcaacatgccggagcaactcatcccagtatcaataccggattgcctgtactatttatggggttggttttgtgaactgtctggaggcaggggatatgcggaggttggggcactgcctttgacattcagcgagatcagggcttgggcggaagtgacaagaacagaaccaacggcatgggaaatagaagcgataaaacgaattgaccgggcatatttaacggagtcaaataaaaaatgagtaatgatatcgccgcgttatacataagaattgattcaacaggcgcagtcacagcttctaaagatttagcctcactggacacggcggcggctaaagttgaagggtcaacaaagaaagtcgaaactgctaccgcatcggccagtcggagctttggacaaatggcgacagcggtaaaggctttggctgcatcctatgctgtcttgaaaatggcgcaatatgtaaaagaggtaactatgttggccgctcgctatgaaactctcggtgtggtcatgcggattgtcggaaataacgccggatattcaggcgcgcaaatggcagcctttgccagggggttggaaaaaaccggaatatctatggttgaagcccgtcaatctctcacgcgcatggttcaggcgaatcttgaccttgcgcagtcctccaagctggcccgcgtcgcacaggatgcagcggttatcggcaatatcaattcatccgaggcatttcagcgcatggtttacggcattcagtccggccaagtggaaatcctgcgcaccatcggcatcaacgttaactttgaaaacagttatcagaaggtggcaaaagccacaggtcgagtgacaacacaattatctgaagccgaaaaatcgcagatcagaatgaatgctgttatggatgccggcaagatgattgccggaacctatgaagcggcaatggggacggcagggaaacaggttctatccttgcagcgccatctagataatctcaaggtagcattcggacttgccttcacgcccgtgctggcggaaattatcgaaacgattactggagccattactgatcttaacggcgaattgagcggcgacagcaaagataaaattaccgcgtggggagttaatttcagaatcgcactgattgacatccaagcagaaatccggcgtttggcaatgcttctggacaaattgggcggaacgatgacgtccgctcaaatgctcctttacggcccagggcgcgcgcttggtgtaaaaagctcaacggagagattcgagcgggcggcggatgcaaatatcggatatgaagcccgttataatgcgtctgataaagaacttgagcggctcatggcaaagagaatccaacttgagcaatcattgaccgccgaaggaaaagcgtcggcagaagcggcgcaggatgcgactgaaaagaaggttttggccgcacaacgggcggcagcggctacgggaaaggaagttgaggccgacgaaaaggcggtcaaagccgctcaaaagttccgggaagaagccaataaaataaatgaaacactgggcaatgatatcaaaatgtccggtcttgatgaccttgaaaagaagctttttgaaattcaaatcaaatatgaaaaattgggcaaaaacccgcttgttgacaagggtttgctgggaaaggcacggggaattgaagagtctgacgcgaaaatcgaggcatataaaaagatagcggaatccaataagaagatgcacgaggaaatggtgcaaggcgaaaaacaatatacagatataattcgagagttacaatccaatatagtcggatattacggagacacgacaaaaagtattctcgccgaagaagaacgtaaatatcttgaaataaatcgactaatggatgctggccgtatttcttttgagcaagcgcaggctgcctggttgctgattgagcaagaaactacattaaagctaatggaagaagatgctaaaaaacttgaagcaaaagctgcttattatcgtggtatagaggggatgtctgataaggctctccaggcagaattggcggcaatagagatcagaaggttaatgggaattaatatgtatggcgatgtcgccgcagccaatgccaaagcaaaccagtctcaaataaaggcatattcggaaaagatcgacgccgatcaaaaatgggcttcgattgtaatcggcaattttggcagtatgctggatgcggcaaaagaatgctacgacgaagattcttctgagtataacaggctgaacgatatgaagaaggctgtgttgtttgctcaactggcaatggaagccgtaaaaaatgttcgcattcttgccggtatccgcgcacaaaccgccgcgactgtaactgcagcggggatagaaaatgcggcaaattcctcaaaggctgtaactggtgccgtggccgctatcgcaactcaagggagtggtgatccttacacggcctttgccagaattgcagcaatgatagcactgatgacatccgttctcgctatggcgggaatagcattcagcggcggcggcggcggtagttcttcggctgctgcatctgggccttcttatggccaggataccacagtcctcggcggtgcgaatgggcaggccagcgaatcaattacaaaagtttttgaactgttgcaagacacgtacgacatggaggaaacaaaattcaataacctctacagcgaaatgaagaacctgaaccggaatatcacaggggtggtaaagtccgttgttttgggagatatcgggaatatgacggaaggacagttggcggcagcaacacctggttggaaagcatttgatgaaaaatattttggtagttggatagcggaaatggatcaaaaatttatggatgccatagggaatatcccgattatcgggggggttcttggcaacatagtatcttctctggttggtggcagcggcggggaaaaaagtttaaaggcttctggaatcagagtcaagggcggggccgtaaatccatacaatatagtccacactgctggggtaaattcatcttggggtttcggcggcagcgatgagtatgatacccgcattgatcggaaagtcgatgatagtttgactgccttcttttatgggccgaacggcttatcagcgacaacctctaaaatgttttatgatgttgcggggggacttggtaaagatgcagacgctgccgccaaggtgatcactgatgctttcctcaacatgggcgatataaatctcataaaagccaaaaccccggaaaagatacaaaaggtaataacagatcgattatcgaagcttgaggacgtagcggcgcggagtatttttggcgatgaatatatcaacaaatatatcaaggtcaatgagggcgcggctgaaacgatttttcgcctttatattgatctggaatccgtgaactcaattcttgacatgaccaccaagtcaacgatctccagaacagttgatttggctgaatcactgattgaactcgccggtggcctcgacaaactccaggaatcggctaccaattattataatgcgtttttcaatgataaggaaaaacaggaatttcttaaatctcaattatctgaagcattaagttattatggaatggatttgcccggaacgcgatcaggatatcgcgctttggttgagtctcaaactctgtcgacagagcaaggagctgcaagatacgcggaactgctgatgttggcagaaaccgcagacaaatattataaatatatcgaaaaagcggccgaaacagcaaagggctctctgaaacctgaacattactctactaatcttgaataccagagagcacttgccggacttcaatcatttgataatggcgggatgtcggtagggcccgaaagcgggtacgtggctcaactgcacgggacagaacttattgtttctccccgcaatagttacccggcaacagtaaaaggattgagcaatgatgaggttgtggccgaaatcaggggactgaggaaagatatcgggcaggggaatttttattccaaggccaattccgacaaaataacatcaattctaaaccgatgggaggggacgggactccccgaaacgaggacatagtggaatttattaaacctattgcaattacagatgcgattcttaccggttctaacgttccggaaaacgattatgctgagtgggttgctagaaatatattattcgcagcactaagtcagactacgcgcgattggtgtggcatgtgcgctgccccgaacggcaatgtgtacgcctgtgtctataatggcgacatctacatgcagacagcgggcagcggggcctttgttgccttagggcagactgtgcgcaattggactggcatggccgctgccccgaatggcaatgtgtacgcaagcgtatataatggcgacatttacatgcagacgggcggcagcggggcctttgtcggtttagggcagtctgtgcgcaattggactggcatggctgccgcgccgc

SEQ ID NO: 305 - DNA, 3181 bp, Unknown
  metagenome-derived sequence
  misc_feature (1)..(3181): contig with Unk19 CRISPR spacer BLAST hit
  misc_feature (1487)..(1514): Unk19 CRISPR spacer BLAST hit
ttcgctgaacgtaacaaaagaaacctatcagtccaatgaaatgcgggcggacaggcagatagccgacttcaggcatggagtccagtcggtagaaggcagtattgctggcgaattgtcgccggggacgtataaactcttgatggctgcaattctccgcaaggactttgtggcggctaagattgggggtccggaaagtgatattacggcggcgtcaacaagtggagctgcagggacgtttacatcggcggcaacggcaacattcataacagatgggctgaaagtcggcgacgtagtccgatggacagggttcacaacaacgggcaccggcaacaatgcccgtaatttcctaattactgctttgacgcaactggttatgaccggaatcatgcttgacggcaatccggtagtggcaaaggtggaaacgggtgcagttacggcaactggtgttggcaaaaagacctggactccggcgaccgcacataccgagaattggtttgccgttgagcataattattccgatgttgacctgtccgaggtgttttatgacctcaaagtaaacagtatggccataagactaccggcgactgggcttgcgaccgttgacttcggccttatgggactgaattatgccaactatgcttctgcctcgtcaccgtattttacatcggttctggctgcggctaccagtggcattcttgcggctgtcaatggtgcgttgtatgttcagggaacgaagattgcgcttctgaccggtctggacttcgacgttgcgtcaaacctttcgagcgaaccggttgtcgggtcaaacgtcaagccggacatcttcgatggccgtgtggccgtcaagggcaacatgacagtgttcttcgaggatgctactttccgcgactacttcttgaatgaaaccgaagtgtctattaactgcgtgtttacgacagggacgggagcgaccgcggactttattgcctttaccatgccccgcgttaaggtcggaggcgcatccaaggacgatggagaaaaagggttggttcagaccatgccgtttaccgccttgttcaattccgcgggcgatgatgggacgaccaacactgtaacatctctggcgacaaccctgagtattcaggattcaaaggcgagttaaaaaaataagcaagccgactggccgaagtgtcgggagcggcctctaaggaggcctggaaggagaatgaaaatggacgaaagaagcaaagcctgtgcggaagtagttgagcagattcttgtaagcaatgcttatatggcaacaaaatatgttagcgacaagttgaccgtgaaagcaaccagaaggcgttataagggcaagccacagaagggggcaaacgttgatatggttttgactattggcaaaccgaattatgaacaacgtaaaaaaatcaagcaggcaaaaaaagaaaatcgttggccgatagaaatgatggtaaaatatccacagaaaaaaaagtaaccattaacctggcggaggctaaccctccgcctataaacaaaacttaggaggaaaacaatgaaagagcgagtagaaaagacaatagaccttgcggcactggataccgtaaaaggcagtaacgccggttttgaagtgtccatttacaatccggcaacccacgaggatttaggcttgttcattanagtnctcggcaaggactcngacganttccaaaaagtatccagggcgcagcagaaaaagcgtattgagcaaatgagtaagggcgggttcagaaacactaacgtgccgattgaatccgtcgaagcggatggcatacaactgctggcaactgtaacaaaatcatggcggcagggcgaaaagcagacacttacagtagagggcaaggaactgccatgcacgaaggacaatgcagttatactctatgagcggttcccgtggattaaagaacaggtagatacggcagtcggtgaccgcgcaaattttatcaaaacctgattgattcgcttgtcgagtatgccgagcatgagttcgcgcttaatgcccggcagaaagacggcgcgacattgagggatcatcttgagagtgtttataggcagacaggcaacatgccggagcaactcatcccagtatcaataccggattgcctgtactatttatggggttggttttgtgaactgtctggaggtaggggatatgcggagtttggtgcattgcctttgacattcagcgagatcagggcttgggcggaagtgacaagaacagaaccaacggcatgggaaatagaagcgataaaacgaaattgaccgggcatatttaacggagtcaaataaaaaatgagtaatgatatcgccgcnttatanatnaganttgannnnacaggcgcagtcacngcntcnaaagatttagccncantggacacggcngcggctaaagtngaagggtcaacaaagaaagtcgaaactgctaccgcatcggccagtcggagctttggacaaatggcgacagcggtaaaggctttggctgcatcctatgctgtcttgaaaatggcgcaatatgtaaaagaggtaactatgttggccgctcgctatgaaactctcggtgtggtcatgcggattgtcggaaataacgccggatattcaggcgcgcaaatggcagcctttgccagggggttggaaaaaaccggaatatctatggttgaagcccgtcaatctctcacgcgcatggttcaggcgaatcttgaccttgcgcagtcctccaagctggcccgcgtcgcacaggatgcagcggttatcggcaatatcaattcatccgaggcatttcagcgcatggtttacggcattcagtccggccaagtggaaatcctgcgcaccatcggcatcaacgttaactttgaaaacagttatcagaaggtggcaaaagccacaggtcgagtgacaacacaattatctgaagccgaaaaatcgcagatcagaatgaatgctgttatggatgccggcaagatgattgccggaacctatgaagcggcaatggggacggcagggaaacaggttctatccttgcagcgccatctagataatctcaaggtagcgttcggacttgccttcacgcccgtgctggcggaaattatcgaaacgattactggagccattactgatcttaacggcgaattgagcggcgacagcaaagataaaattaccgcgc

SEQ ID NO: 306 - DNA, 1751 bp, unknown
  metagenome-derived sequence
  misc_feature (1)..(1751): Contig with Unk19 CRISPR spacer BLAST hit
  misc_feature (725)..(752): Unk19 CRISPR spacer BLAST hit
tcccttatactcctcaacttttatacctgtctttcgcctgttttaataattttgtccattttttcttccttgatttaagtttcacatccaacacggcgtgaacatgttcccgtttgctttaaccttaaaacttcctacacatgttccgccctgaattgtatttgcacatagtgtacacttgtccaggttctttttattccgatcaaattccatcatccggttccatatgattttatttttaaaaacatgtggattgcaaaagccttcttcacgacattcagtaaaaattttcccccacttttccagcagttcacccgggattttctttctgtacaatttccactcagattcagtcctttgatagtcggaaatatattttgtcatcgctataatatcttcgctatccaaatgtttgtacataatttcatagggagttttggattgtgcttgacactgggactaatccgctcatttttattttctccctttttcggtagtccggcatgtttatttttattatggtcatgtcggcaagtcttgacgcttatacgcgcgcccagatttatccctcaaattttcttgcaattgataagttttgttgtaaataattnncggccttcagcttcgcggttttcgccgatcaataattaaataaaggctttggatggtaaagtccgatgttttttccgaaccaagatcatcaagaattaatagctcgactttagaatacttatcaataacctgctcttcggtttggtttggatcacttttctcccagctatcgaatgattttttttggccgaatgttgcacgtatctctaaaagcaattccggaacagtaataaaaaaaacttcacgactcctgctttccaataccaactcgcgccataatgaaacggccagatgcgtcttcccacaacccgttgtccctgtaaatactatacttcccgggtaagaaagcaatcctttgtcaaaacttgcattaaccccttcatatatacgtatatcccgattatacgcacttataaactccagacatttcttttttattatatcaccgcctctaaaattatcaaaggatgcctccctgaattttgccggaactcctttcatccactcttgagggttttgtttctttttttcaagaaaatcttttcttgctttttcctcttcttcacgctccttttccgccttttccgccttaacacatcgctcagcttccgcctgctttttattttcttcttcgcattgcgtgcatgcctggcctaagtgtatcccgtgattgcacttaggcgtctcaaatttactcattgcattcgatgtcaaccgggtacggctggccatcgcttttcgcttttccaacaaccgattgtttgcttccaaaagccccatatctgtttccatcattttgtcctcctgtttttaattcatcgtcccaacatcccttgtttagccacgttgccggattcttccattccggcctaaattcaccatttgctttttctcgccattcggtttgctttctgattgcctccaatagttcttcgataggcggacgggtgctgtttaactttttccagcatttcaaagtgtattttttttccgtcttgtttggatatgctttccagaaaacttcaaaatcagattctttttttttatttatattggcgtcgttgccatttttggcaacatgggttttttctgtatctgtatctgtatctgtatctgtatctgtatctgtatctgtatct

SEQ ID NO: 307 - DNA, 685 bp, unknown
  metagenome-derived sequence
  misc_feature (1)..(685): Contig with Unk40 CRISPR spacer BLAST hit
  misc_feature (209)..(236): Unk40 CRISPR spacer BLAST hit
taagagagaagaaagaacaaaaggagaatggtgcaaaaaatatggtatatctcaacatcaaacgcttgtttgggaacgattagatgaattttggtctgttgttaaggtagcagagcgcaattgtgctaagtcattactacctgattttatcttcggcttacagaaggcattaagaaggggcgacgtgaacgctatgcgcttctataagcaatacttcgaggagtggcaaccgaatataaacgttaatcacatgcacttaatacaacaggtcagcgcagagattgttcaactggacgaaacagggaaagaagagctacagctcaaacggctagagcaagcggagaatgggacaatcatagacatttaataggcacaagcatcattgtgcaaattaaaatatgccccgtgtagggggtcgggggtatgaaatgggtcccatcccccaaacatcttaggaactgaacccccataaatgataacaacaaaaaaagcatcaataattaaccaacaaaaccatgaacacgtcaaggggaaagaaggaggagggggtagagtggttaactgatgggatacatcattgtttaataaggcataatgaaatatgtttacgttgtcatacttgggctaagtggaatgggatagttaggaggtgtagtaagtgtggggagttggaataccggaagga

SEQ ID NO: 308 - DNA, 23985 bp, unknown
  metagenome-derived sequence
  misc_feature (1)..(23985): contig encoding Unk54Cms1
  misc_feature (5329)..(6971): CRISPR spacers
  misc_feature (8984)..(12508): Unk54Cms1 coding sequence
tcaaaactaacgagcgatccgttatttgcaagaggttttgcacaaatatacaatcctttaaaaaaacttttaaaagtctcattagatatcatttgcgaagtatttcggagtaatagtgtgcccagttcatcgtttaatctaattcgaacatgagcctctattaaggaatctaattttacttttgatttaggtttaggagcgagccgataatcataatcataagttaaattttgagacgcatgagcaaagatacgattttgatagtaaacttgcgaggaagaaatatcttcagttaatctaaatatttgaatagagaatggatttaaggtatcgccgtagaaattaccggagtatcgaaatgtgagcacgatagaatcaagttgtggatttgcaccgaaattgacgctgtttccagtgggaataaattgagcgaatattcccgtagaagtaatcccgaaaacggggtctctgataaaaccaagaaaattagattggagatttcgggtattcaatgtatcctctttaaccgagtatgctaccaatgttattgtatctgtataagtagcattcaagaggtcatcaataattccgagagaaccaggatcttgttggcatcctagataactaattaacaggatgaatgatacaatgaatgccaaacaataagtgaggtaaaaattaaaattcgcgcggattgagttccaaaagttcttcataaaaatggttatattcgtcaacatattctaaataatcttctgtttcagggtgatagatatagggatattcgtaatttttgaaatattttttcaaagacgtagtaatgttaggatgtgcaattacggcagcatcagaaaagtcaagggcagttttcataatagtgtcgtagcctgcggctcccttaaaatgggtcaaacattcgcgcgggatgccggttattttcaattttttcaaaaaattagatgaaaatttttcagaaaaataatcattatagacagaggtaacaattctaacatcttgaaagagtggattgtctctgtaaacagtacggataaagatggggattagtgcgctcaaccaaccgtggcaatgaataatatcggggttccatcccaactttctgacggtttcaattacaccttttgcataaaaaagtgcacgagaatcgttgtcgtcaaaaaacttatttatttcgtcagtataaagcgctttccttctaaaaaaatcttcactgtcaataaaataaacctgcatgcgtacggcttgcaatgaagccaccttgataatgagcgggtagtcggtatcttcaataataatgttttgcccggaaagccgaattacttcgtgcagcatgtttttacgttcattcaccaagccatatttgggcataaatgttctaatttcattctctctttcttgaatgccttgcggcaaatatctgcatacagaagaaatatagtcctccggtaagtagggaaaaatggtgggggtgatgaataaaatccttttttttgacatatctaaaaaatcagtgtgcaaaaatatataaaaaaaacggaaataattgaaattatttcaaaaaaaaaatcattttacttgaattatataaaaaatatgctattattgcggcgcagttaaattaaataaaaattattatgaaacccgtaacatgcttcgcgtttattcaaaacgcaacccttgaaaaaaggctaattgactgtttgtcaagatttaaatccattcaattttatggatttgtgaaccaccgtgtagattttttagagcgaatgaactactttcgccctgaaatcttaattctggatctgtctcaacgaaaaaatgaagagatagacattttagatatgattcgcaagccacccattattttgggcatccttccctcgaaagagaacccgcatttttggcttgataaaggcttatttgatgtaattcccgcgcaattcaccaacgatttgctgattcgtaaaatttacaaaatcctccgcattatttcagaaattaataattcttatcaattagaaacgattgcggcagaaaatcctattggttttaaacctccaaaactaactccaaccaaggatgttgactattttttcattcgttatcaaagagttacaacgaaaattaaagccggtattattatggtaatgacaaaagagaataaatatattgctattgaaaccactaccaaccaactctattttcacgaggcaacgattaaagaaacggcaacaaaactgcatgccgcatacttggttcgtattaacaattccacgattatcaatttgaattttgtggataaagtggaaaagaacgctgtgaatatgggggagcgaaagttcaccgtttcgcgctcttattactatcagtttagaaaagcgctggatgaaatccagaagaaagaataaatgattagccctgtgaaattttgtgttctttgtgtctctgtgttgaaagaattattcagcacagaggcacggagtgcacagagaatcacagattatttaatacaatctctaattaaatttccataaaattccggtaacggaatattattgtatgctaattgccttggtataatgctcatcgcggtttgtccgggaatagtgttgatttctaaaaatatagcttcatttaacggattgagaataaaatcaatgcgcaccacgcctttgcagcccaattttttgtaaatcgtttcagaatattccttgatttctttttcaataattgggtgaatttcggcaggggttaccaactcaagatatccgggcgtatatttcgcctcaaagtcgtaaaactcttttttgctttttatctcagtaacggcgagcgcagtaactttgccttgccattgggcaactccacaagtgagttctctgcccggaataaaatgttctatcattacttggttatcttccttaaaagctaacgctatggctgtttttaattcttctaaattatgcgctttggaaacgcctacgcttgaacctgaattacagggttttacaaaacagggcaacccacaatgattaatcacaacatcataattaatttcatcatctttataaaagtgcaaagagggcgagataggcacgccgcatctgtaaaccgcaatattgcaaaaatatttgttgaaagtgagcgccgagcaaaaactgtcgcagccggtgtaaggtatttgcaacatctcaaaataagcctgcaactttccgttttcgccagggtcaccgtgaatggcaataaaaactacatcaaaagtgattcgtattttatctatcgttaatgaaaaatcatctttatttatttcaaaaggatttccattagaatcagtatatacccattgattatcttttacaataatcaaataagtttcaaactgttttatatctaattgattttgaatattggcggcagttttcagcgaaatatcgtattcccctgaatttccaccggcgagaagggcgatgcggagcatgaggtaatatatttggtttaagtgacaagattttttttctccattttaaaatggcaaatcatccgtcattccttcatctgtgaaagtatcaaactcttggggaatgtcttttgcagaagatatactagttgcagtatgagataattgctgaggttgtgcggcttggagattggcgcttacaggttctactttccatgcttttacgtcggtataccatttgccgttaaattcacgtgattctaaatcgaaactcataactactttgtcatcaatgtttagaatttccatcattgcgattttttcgccccaaaggttagcgcagattttacggggaaactgttccatagtttcaatcacaaattcttgcttttgccaagtgtttcctgttttgctaatgccagactgcatgggcattttttgaataagttttccaattacttccatataaaaaattatataatatattgttatttaaatagttttgatattaatcgtttgtaagaaaaatcgttgcaaagtaagtattttctttttatgataagagtttttttttctcatcataattaatatatttgcaatttcaaatcataatttatgaaaaaaataaaaaacattcttattacgggctgcaaagggcagttaggcaagtgcttacgtgatgcggtgaactgtagtttacataattacatcttcaccgatattgaagaattggacatcaccaatattgctgctgttgccgattttgtgcatcaaaacaaaatagattgcattattaacactgccgcctataccgctgtggataaagccgaaaccgaaccggaacttgcttttgatgtaaataaaaatgccgtgtggaatttggcgcatatttgcggagaacaaaatgcttttcttattcatatttctaccgattatgtgtttgacggaaaggcaactataccttataaaaccaacgcacgcaccaacccgacttctgtttacggacaatcgaaattagcgggcgaaaaggctattttttgggagcaaattccaagcattatcattagaacatcgtggctatattctcaatatgggcataattttttgaatacaatgttgcgtttgggaaaagaaaaagcagagatacaagtggttgatgatcagttcggggcgcccaccaatgcccacgatttggcagcggcaattttgcaaataattctgcaagcggaaaaaattacgaaacccactgtttttcattatgcaaacgaaggcgtaactacttggcacgaatttgctcaagaaataatgaacattgcgcaattgccttgtgtggtaaaaccgattactacctctgaatttcccacaccggctgcgcgacctgcctattctgttttcaatttatctaaaataaaaaaagagtttcagattgccatacctaattggaagggtagtttacagaactgcttaaatagttaatattgcattttttcgttacgcgttactatcgttacacgttacattattcatttttcacctttcaccttttacctttctcctttcacctttctcctttctcctcattatccccaccgcaatccaaaacgtaaccgtaacgcccaaaaaagcgccgagcagaatggggaatttgtccttaccttcgtacaaaacggttaagggaacgataaccacgctaaggaggagaaagtagcgaaaaacggttttcatattgttttataaataatgcgcggcgaaaatatattttattggatatggattttctgaaatacgaaacaaagaaaagcgaggtttgtatccccgctttagatgttttcacaacggaataatccttattgatctacaatagtagaaattaaaaaagtcatattgacaaccctcttaaacaaacagtattaacctatctacaatagtagaaattaaaaaagtcatattgactgtttgcgaaaacaaaagacggatcagatctacaatagtagaaattaaaaaagtcatattgacatgtaaatttatggaatggatttcagtatctacaatagtagaaattaaaaaagtcatattgacaagaaaagtgaacaattttgctcaaaaatctacaatagtagaaattaaaaaagtcatattgacggagagtatgaacgttcatttgcaacaaatctacaatagtagaaattaaaaaagtcatattgactttgaagatatattgtctgggtactctttatctacaatagtagaaattaaaaaagtcatattgaccttaaaattttaaaaaaaatgagtacaatatctacaatagtagaaattaaaaaagtcatattgacagcggcgcaggattgcgttcaatgcctgatctacaatagtagaaattaaaaaagtcatattgacaaaacaacgcaatgagttgctataaagatctacaatagtagaaattaaaaaagtcatattgacttaccaaattgcagccttgaaagtaggtgatctacaatagtagaaattaaaaaagtcatattgacgataggaagcgcactaataccggtagttatctacaatagtagaaattaaaaaagtcatattgacgaacaaagtacaggaatatgtttcgatgaatctacaatagtagaaattaaaaaagtcatattgacactacggataaagaagttgaagatctatatctacaatagtagaaattaaaaaagtcatattgacttgaaattggcggcgtgttattttataaatctacaatagtagaaattaaaaaagtcatattgacggttaattccgaaatcgttaataatatcaatctacaatagtagaaattaaaaaagtcatattgacatgaccaaagttttagataatcagctccatctacaatagtagaaattaaaaaagtcatattgacaaaaattacattatgcaaaattcagaatatctacaatagtagaaattaaaaaagtcatattgacgcttaaaatgaaagaaaacgaccttaaaaatctacaatagtagaaattaaaaaagtcatattgactttttaacccaaaaataaacaatgaattatatctacaatagtagaaattaaaaaagtcatattgacctaactgacaaactatcaacgcgcaccgtatctacaatagtagaaattaaaaaagtcatattgactcaactgcataaattcgaactgatagaacaatctacaatagtagaaattaaaaaagtcatattgacttatgtacttcatcaactttcgacaaaaatctacaatagtagaaattaaaaaagtcatattgaccaagttatcatagtgggcggcgcgtggatatctacaatagtagaaattaaaaaagtcatattgactttgttgtaaatcatattcaccaattatatctacaatagtagaaattaaaaaagtcatattgacctaaatttgtgtgatttttcataaaaaatctacaatagtagaaattaaaaaagtcatattgaccctatatacccaaaagggcacggcgaaaatattgttttttatgaaattagcaaacatttcttaaaaattaatttaccccaccttgttggagtggaagagaaatcaggatgtcaatgaacttaatatcaaaaagatgctatgtaatttttttttgtcaataaaaataaagacttacctttgtcatttcattaagtaaaaaaaattaaatcttggtcgcgatgaatggcagaaccatatttcaacgctgttttttcatctgtggtaaagataaatacgctgtcgccgccatcaaatttttttgcatagtaattttctattctcactttcaaattgtctaatattcgtttcgtattattgacctcaaaaacagaatattgcaatcgtattccgccttgttttattagcgttttggcaaattttgtacgcaatttattgtccgaaatatcataacttactactaacatattttcaaattttaaatcaaaaaaacaggataatcgggtgcgctcttgcgttgcataaaacaacggtaataatggcgcatataaataaaaatatccgatttatactgaatgaggagttcgtaaaacatttttgtgtaatcgttgctcttttctctttttaataaatattcattctttatgaaaagaaaatcatcgcttttgcattgtttggtattgaatgctttacgcacttgttgatctatgaggcagcgaaaaggctctatcaaatcacaaatcaatgattttcgcttaaaccataatctgtgataaacgcccacgtatgggtcaaacccaaataatcgggtaaaagcctcaatataattaaacaaaatggtataaccaatatccaacgtggcgtttatggggtcaatttttgttctcggactgcggatattccaattatgttcttcaaaataagcagcaaaaaaggctttggcaactgtgccttcaattcccattaaactatcgtaatcgtctatctgagcaatgaaaggcaaatattttttacatttttctttggcttctactattttgggcgttttttttcttgttttttctaataagcgtaattgattttggactttattttcaactaattttttggcaattagcaactcctctttcggatattcatattgcttttgcctcaacaaataattggcttctgcggtaatcgaataaaaaaataccggtctaaaattgggtttcattaccaccaatggaatgccgtgcaacctacatttatcaattaaaggcgtggtaattgtaatatgccctataacaaacagcgccaatattttttgaaacggtaatttggttaatgttttcttttggttcaaatcttcaagaaacaattcgccactcttaactctcaaacttttttcttccaagcaattgattacgaaaatagaacggtattcaatatctttatgtgtaaacattttctgtatcggttttatcgcacaaattacaatagatgcaatgggcgcatttattaatattaacggatatttcttgttgggggttaaacattttgaaacggtgaataaattcttttagttcttctttttgcgccctatcgggaatttctacagaaaatgttgtattggatgaaatggcgtaaaatgccaacttttctatttcaaaccccatttcaatcatacaaaaaaattgcgcccataattgataaatttgtccttgatagatttttagcagttggtgtttccgttcaataagcaatttttcttttgctttgtagatatctattttaccgcagatacccaattcgttagaatagaccgacaaccctacgatctcgttttttctgctgctatatttctttttatcaacggcttcgtgactggctttgccttgcgtttgcggcacggcgtgcaccaactcttcgtccccacccatatacacattgtgcagatatatggaataggggcagaagataaagtcgttgagagtggaaatggggatgagggagtccatagattagacgaaatattattgtttttctttcttaaaattttcaaaaccacgtttcgcaatattgtaacccgcaataccatcgttagagtgcataattccttttgaataaaatccgcattgacaatcaaagttatctgtatgctttttcttacttttttctttacaaacaggacattcttgacttgtacctgccgggtcaataaaggcaatattccctaactgtagaatagcatttttgttatccttaataccttcacttctcactgtcattaaacttttaataggtggaactaaaccataattttgaaatttttgataaagtttgcgctctaagattctataaatatttccactgaatttttcgatatcttcccctactttttgtgtatcaaatccttcttttacaattaatccttcgccgttaaaacgatgtttatattgcttataaagaaagtcaagaacacctacagcattggcagcaagcgcttttttagactcagtaatttttaagtccaactcttcatttgaaatattgtgatttgaacgattagtgttaaaactgtcaattagtgttacaatatcgttaatgggcataattgcgtcaaactcttcctttttcttgaaaacgtgcctacaatcaaaaattggagttacatcttgtaaatcatcaccttcaaaacgggatgcaaagatgataggagaattgtaattaccttttttctttaagtatttgtcgttgaatgttttttgttcttcatcagtgaattgattattgtttctatcttcaaaaatccattttagatatttagttttttcatcaacagataatttttcgtattttttaatgtcggaaacatactctgcaaattttaatttttcgttatttgtcaattcttcattgttgcgaagtcttatggattttgccgtttcgtcagccgtatggtcgttcatttcgaaaacatttctttgtgcatgtttgagccataaattgaacagtgcaggaacatcgccattcgtaacgatatgcccacaaatcacctttgctgtagtcaaatccaaactaagcgtatgtttttttgaaaacaatttgatgaacatatcttcatactcctgctccgatttattgaatgtgcgcatatagttttccttttttagaaaataggaaggattttgaataatttttctctcttttccattgtaatcggcttctttgtagtttaaatcattgatagttataacttcaaatccatatttttgagattgtttcaattctgcaattttttcttcaatagttgctttttcaaattctggaagataaacgccaagtgtagaaagttcatcttcgccattgtctaacccaaaggcaaatttaacattctctttttgtagttttctgttaaaactgtcaaccatttttgtgtattcatcatcgttcacaaacgaaagcacttttgtaggataattacagtgttcgctgatggttgtaacaagcgtaaattgcggatgtaaaaaacggttctttttttcaggatcgtaattttggcttttagcaccatatttttcaatgcgacttgcttttggcacacgatatgaaatggcaatttccggatttagtctgatattaaaactgtttatttcgttttcactattccaaaaatctttccaaatctgcgtatgagacttgagattgttttttttactatttcttaactccaacgatgtaatgtcaaagacctgtgccttaaaatgttcaaggctatcttccaaattaggaggacaaacgacataacgtcgatagcaaattttctcgagcgcaatttgaaaatcgtctaaactattaaatgtgtgcaaaataatctcatttttaatttgttcaatcggaatatgaagcacttgttgggcatattctgattgcaacacatttttgtaaaattctattttcttatgctcttctccgccaaaagcaaattctccattgataggatttcctctttcatctttaggaagcaaatgtctgatattgcgattaaattcattgttgccattttccgcaaaaccaaaacagagtttttgtaaactgctgtatgttaatgattcaaaccaaaatatttttgcatgttcgttattgagttttgtaatctcatttaccttttctatccattgtttacattctcctgctttttcttttggaataagcacaagtttatggtgattctctttttctaaaatcaacgcccagtatttcaatagttgcgattcaacttcttctttttcaattcctttgagttgtgcaagaattttaccgtgcttttgagaaatgatacggtaaaaatctgcaaaagacttccattctttaaagttgtctttcattatactgcctcgttcttttgtaactctcgctttcttgcttcttaatcttttcttatcctcttctctcagatggtgattacttaattccgttcccacctcttccatctcttctgttttattcaagtaatccataaataactctttagatattttattaaaaagatacaattcgctattttttaagtcattatgagaactattattttgcattaattcgttaaaaagttttttttgttttgcttttatgtttttaagaatatctctcaaactaacatattctttatcaatcattggaacttcgccgagaaaaagacaagatgtttgcttttccaaaaacgcattttggatatcagtatttaataagtcaaaaatttcttttttaagatagaaatcttgttttcctttttttctattgaaaaaagtattgatagattccatgcttttaatatgtaaactatcttccaatttattaattttctctttaaaatcaataggctttttattaatagtataatagttaaaacttgcttttgcaatctgtaaaccgcttgattgttccggcaaaaacatttgaatagcagcttgtaattggctacgaatagtagaggattttgatttaattcgaatgcttaaatctgtagtttcttctttatcagacgtgttttccatcaaatccatcaaaagtggtaacgcattttttgatgccaaacgttttagcaacaaacctatttgcgctttttttgctctttcatttaattctgagtaaatattgtctatcagagaaacataagtttgatcaacaaaatcaaaaaccttttctatttttgaaatcaactctcttatgtcgccaattttaacttgttctctacgcttgctttccaaatttgtacgttctttaatagcaacaaattcctgttttgcatattgcttcaaccaagcattctttatggtcattttttcattaatgctaaatataccatcttttttttggacaaataaatagttgttgatattctctaaataaatatttaagtccgaaataaagtcggtgagattaaaatcattattatttgtttgaatatttatcacatcctctttaatgtaaggaatatttttgtcgtcggcttctaatttaaagcgaattgtttttgttgttttgtaggtttccatattctttttttattattataactattaatttttcaatctttttacttgctttttttcgggcaaaaagttgtcttcttaggtacaaattgtaccccagttgagttttagttgttcatcgcggctaagcatacgttttacatattgcttataatttagtgtgtttagtttactttactttactttctattgttatttatcagaattttgtacaaactgtagccattctttatttgaaacagccaacctcggttttctcaaatcttcagtttctttaagttgttcaattacccaaagtcctttgcgtgcaatattgtaggctccgttggcatcagcattatccggtaatctcttatttccattttgcgaatcgtaaaattctccgtttttatccgcaacaggggaaatcataaagtcaatatcgctattcgtaatactgttacgcatttgaacagtcagtttaaacagataaatcaaccgttcaaagaatttcttgtcggtttgttggtcaatcaatttttttaaatccgcatcttttgtaacaaacaattttagaaattcgtccgttaaatttatttctctattatcccattgattatttttatcgggatttcggaaagtttctatgcgagagccattcgtacaaattgtccagttcaaacgtgtgccttccgctttgcctgagaatttggaataatcttttacctcaaattcaaaatattttttttcagcattaaaagttatagaatcaaattctgagaaaaaggttttggctttatcaacagttccaacagtttcttttcgtatatcaaataaatttacaaaacctgttaccggacacattttgcttgtgttccaagccggaacataaaataaaaacccgctttgttttccaagttttttaaaactttcgaatttattactaagctgaaacgcctgcaatgttccgcccaattcgtttgcctgtttctttttatccaccaaataattgagtttgtcaatcaacattttttcaaacttttgataaaccgacttttctactttctgcctgccgcgcataaagcccatattcaaatcttccaatactacaatggcattgtatgttaccataagttccgcaatcttatgaataacctgactaatgtacccctctttcaactctttaatagattcaatggttttccagctttcacgctctatttgcctttctttttcccgagcatcaagaagtgtatgatagtttgtagcgtatttatttccattatgttcgtttactatttcgtttaatgaaaactgcttaacaattttaccggtagcgtcaattaaactcaaatagagcaaatgcctttcaccacggtcaataccgatgatgtgaatgtttttagcattatcttttaagaattgattgacatttggattgatgttttctgtaccttcggctttaaaattcatcgttattggaacgtgaaattgaaatttatcaaccgtatagcgcttgtccttaattaattcgtattgaaatgtgctttcaggctttttgttttgttcgtttttattcttaattggctcgttagctttatgaacaattttattatctgatttaatacttgattttctaaaaaacacctccgcttcgccattaagtttatagaccacatttttcaaattttcttccgaaaacaattctttccaatacaatgtgtgcatatttggcgtaccctttgaatattcggaaaaatctttgttgtagatttggaaaagataaagttttccattatcaacaagttcattgatatatttttcagaaatatttcggaaagtgattttgtaaccctgcgctgatacttcattgtaaaacttatcaatactatcataagttgaagtatttgaaaaatcgaagccgaaatgtttccaatctttatgctttgcgattgacgatttaaagaagtcaattatttcgtgcattttgtttttatcaaaagtatcaccttttttatggcagccattttcatagttttcaagaattttattgcttggcgtaaattcagttttacctttttctgaaaaaaatacttttggcagcattttatttggtccgggtaaaagtttataatccattttttcgtaaaaaccttccccatcttttactgtttcgacgttgtcaaattttgttttggaactgaaattcataattgccaagtagtaattactacctttccgtaaaagaattgcagtattgtcttgttctttgtttttatcccatccgtttaataacgtggaattttcaaaattcaacttaatcttttcttccgagtaaggtttttgcgtcatatagttacgcactttgttataaagcggcgtaattttgtctaactcttcccaaagcggcgtaaattccccataaaatttttcatctttgtccgattcatttttacccaacaatggcttaataaaccgctgaacatttttaatactgtctaaaaacagtttaattttttctacatcttttttctcttgcgacaaatctttattttcgggataaggagcattgagtaaatcttttacttgattataatgattttctatttgggcaaaaagattttccgtatcttcttttttgccgagattagtaaaatggtcggcaatgtttttggtgcaaacttgtccatctttttcaatatcgtccaacagagccaaacattcattcaaaaaaccaatggaaaaactatcgtgatttttgtaatacttttcttttcgctccgcaaatttttcttccgtttctttcggttttcttggattttcgttttcaaaacgacgttccactgctttttgtatagtcgcccacgaaccgaaaagttgttgtgaaatatcggttaatgaagcatcgtttcgtaaataaatattatgtaaatcataatcactcaggtgtaacagcaactcaataagagattgtttttcttttggagtaaaaatttcttcacttagttctctataacatttttcgatactttccaatacttcattatcattccctttcgtaaattcttcgggcaaccacgaaatggcgtttcggtcgcttaaaatctgtttgaaaagtggtttaagtttcgggagtttatctgtctgcttttgattatagagatttatatattcgtttaatccttgaatttttagttttccctgttcttctgattttccgccgataacggtattatagacatcaatttgttcctgtgtcagaaaaccggaaaaagcgtctaatctgaaaatatcttcaattttcgtaacattgagatattcctccaaatcattataaagtttttcaaaattttcggcaacaggtgtattttttactttgtcaaaagtagagatattatctatgaatttcggtaaattttcgtgtattaaacgataggcaatagcagttgattgatcttctgccgaatacatattttttcgattttcgtgaaaacccgtaaagtaggtagcaaaagattcaaatttctttaagtcattctcaaaattatagtcttgtggaagttttaaatctttaattagtttttcagtaatacttggattttctttcaaccaagagtttagttttccttctgttctactttcctttttacttgcattatataaatctgcggattcaaggtctttaagatttgtaaattgttcggctatttctttgcgtaatttagtttgtaattcttcaaactttttcttttgtgtttcatcacgttttaatttgtaataaaagaagtagctggcaagtaattcattattcaatttacaatctttaagcgaagatttaataaacgccttatggaactcgtcaataattttttttacttttttataactttctgcccgctgattatcttgcacaagcagtcctttgttttgaatatattctaatgtttttccctgtggtatcaactcaaaccggagcgttttgctcaacgaataaaggttggtaaaatttgctaaattattcataatattattgtttaaattcgttgtgcaaataaagaataaagttttatttttcttctataaatttttgaaacatctaaactttcttatttatgtcacaaaaagaaataaaaatccaaacttccgagcaactgttgctcgatgatctttctcaacttattgagcaaagtaaacagtttgttgttgttcaagcaagcagtaccaaataaattgcgcactgttcacggcggcgaagatacaaacttttgaaagcaattcacaacggttatccttaccttttatttgatatttttcctgtttttaatgccatcttccaacattttaagttcttgtacatcggctaaatctgcttgttcaagttcaaaaattttgcgtttttcattaaattgctcataaacttgttctacaaatgtttccatttcggcattgctcacactgcctttgccggttagcagtttctttttattgaatttgataatatcatcaacgttttcgtgccaaaagtgcatcgtaatttgcttgcggtcttttgcctgcaattctgcaacttccaaaaatatgattacaagcctattaagactgtctaattcatctgcggtcaggtaattttttgaaatgtaaatatcctgtttgcgaactattttacctttccaacttgttaaagccatatttggttcatttgcattggcacgcgaaacaataatttcagcggcagttttgcctgtaattgcaaaaagaagtttgttttgtgtttcggcaaaaaacatttgcgtggctttgtcggtagcatcgtaatcggcagcaagtgcaaataattctcttattttttggtaaaaacgtttttccgaagcacgaatgtcgcggatctgctccaaaagttcatcataataatcggggcgaccatcaggatttttcaatcgctcatcatctattacaaacccttttatcatatactctttcagattacggtttgcccactgcctgaactgtgttccgcgcttgctgcgaacacgaaacccaaccgcaagaattaaatccaaactataaaaagtaacattgtagtttttgccatcggcggcagttgttaagtattccttaataactgaatttgcatctaattctttttctttcaaaatattagatatgtgcatactgatatttggcacagaggtgtcaaaaagttccgctaattgattttgattcagccaaacattaccgtctcgtgtcatcaaagccacttttgtgctgccgtcgtcagaattgtaaattattatttcttgatttgagttatcaggagtaaggttggtaaaatttgctaaattattcataatattattgtttaaattcgttgtgcaaattaacaataaagttttactttagtatgtttcaaaaaaataataatgaacgaaaataatattagtttcatctatatacaacacagagacacagcgttcacaaataaatcactaagcctttcacgaaactccccataatcatttatctgcaaaagccttcttaattccaacgaattgagttgccaaaacactgcgaaataatgccacaattcttttaatgaggataatgcgattttttcaccgaattgggcttgtaatatttcggaatattcattgtgaaaactgataaaacgttctttatctgtttgtgagggcgaattattattcgcccccacgaggttatccctaattctttctgccaataacaaattttgcaaaaccccgcgtcccaacatccaatggtcaatttttggaaaacgttgttgcaatttcataaaagaattaacatcaataatatcgccgctgtaaacaatgttgtgatgggtggtttggtaaaaggtttcaaaggtgtctaaatccacaacgccttcatattgctgtgtgcctaatcgtgggtgaatgcaaaggaaatcaatagggtagggggctactctttgcaaaatctctaatccttctttttgggaatgcaagcccaaacgcattttcaaagagaaacgcgcggaagttttgccgcacacttcattcacaacctcttcaattaaatccggaaagggcattacgccgcagccgcgcttcttgcgcacaatggggttcatgggacagccgatgttccaattaaactgttggtatccaaaagtttcttgtaaaacaaccaccgtatctttaatatcctccggtttgttgcccataatttgcggaatgataggcaactttgcattattttcaggaaacaaatcgcgcagttttttaggattgagcgtggctttggattgtgccgcaatgaaaggtgcaatggcacaatcaataccttgaaaatgtttgctcaaacagtttcggaagtggtagtaggtaataccgtgaagaggggcaagccaaagggtcatattatcaataatattcaatactcctcactctttttcgcaccgtatcattgccacgcaattgtatctcttccaaccagttctttgtattatcatgcagcggataaatcttgtcatcgcgaatgttgtgcaaacggtcttcaaagattactttttgcaataaaccttcgttattgtattgggtgtaagtatattcaatcatctctttggaggttttgtaggcgcggcggttcacttcatcgccataattgtcatattcaatagtaacatacttgtagagtgtgttttgcgggtcatattcttcaatgcgctccaccaagccgttggcgttgtagtaaattttattggtaagcgtatattccggcagcaaacgtttcatttcaataatgccgccaaacgcatcggttttatacagaatcttatacaacaacgaatcgtttaaccaaaactgttcttcgcttttcattccgtttttatcatacataaaagtatctttggtaacacttaaatctctgtaattcttttccaaccaatagttttcgttagcattcggcaaataaaagagtgttcttttggaaacggtgtcatcattattatccaataaaaatacttgggttaaataaccgtctgagctgtaatgttgaatgtttttatttgatagataataagttgaatctttgtcggaataataataggtaatggtttccacgcttttcacattgccgaaatatcttgcgcgttgccaatgatttttcagggcatcgggcgtaatgacaatttcggtggtttttcttttacaagagaaagaaaatgagacaataacgagcgcaatgaagagaagaaaaaggttattttttggcatgtctttttctacgggctaaatttgcgggttcaattgccagcgcgtcgccgtttaaaagcgctgccacgccttcggtttggcacttgtgttcgcagttgttgcactcgctgttggcagtataattatccggttctgtgtaagtggtaattacgccttcaaaattgcgcagcaccacgcggttgttgccttgcgtaatgagatagttgggcatcacggggattttgccgccgccacccggggcatccaccacaaaagtaggcaccgcatagccggaagtgtgtccgcgcaatccttcaataatttcaatgccttttgccactgtggttctaaaatgctcaatgcccaacgacaagtcgcactgatagatatagtaaggacgcacgcggttcattaccaaatcgtgcactaactttttcattgtaagcacgcaatcgttcacgcctctaagcaaaacactttgattgcccaacggaataccggcatttgccaattttgccagcgcggtttttgcctcgtccgtaatttcgttagagtggttaaagtgcgtattgagccatattggatgatattttttcagcatattcaccaaatcgtctgtaatgcgttgcgggcaaaccaccggcgcgcgcgttccaatgcgaataacttctacatgaggaatttcgcgcaaacgttgaataatgctttccaacatattgtcgctcaccatcaaggcatcgccgccggagagcaacacatcgcgcacttgcggggtggcggcaatgtagtcaatggcgcgttgaatgcgctctttcggactttcacagtcgtgctgtccggcaaaacgcctgcgggtgcagtggcggcagtacatcgcgcactgatctgtaattaagaacaatacacggtctgggtagcggtgtgttaatccgggcaccggcgagtcttcatcttcgtgaagcgggtctaacagatccgccgctgctttgtgcgtttcaaatttggtaggaattgcctgtttgcgtacagggcagttcgggtcatccggatttatcaggctgagataatagggcgtaattgccatgcgcaacgttttcagcgattctttcacgccgttttcttcttcgggcgttagttgcacatattttttaagttcttccaacgtttcgatgcggtttttcaattgccacttccaatcattccattgaaggtctgaaacattggggaaaagtgtggtacgatgaggggtcatatagaatgatgtttttgggttgcaaaaatagattatttacgaaagaaacttatttagtgataatattttgcaaatcaatagcaataatgcttctaaattgtttgtcgtacaaaatattatccataatgaatgcgtttgcggtggcttcaaattctgcaactctctcaccatcattattcaccagataagtttttttatcatttgcaatgagataataatcttgatattgttcataataaacaccaatattttcatagttaatggtgtgcatcacattaaattgttcatctaatgtgataatttttcttgtagtggtataaatttgaatagttgataaatcgtattgatcaataaataaaaaagaatcatctctattagcgataaaatattgatttcctgcaaaatattccaaatctccaataactgcttttgaaaaagttgtttcgagtatttgtttccctgattccaaatcatattttccaatggcatttttaaataacagataaatttcattatcaatgagtttgaaatcaatcacgggaccatcatttttatttaatagttgaagatatttttgttttccggttgttgcattaaaagcagcgataaaaggctttccataatctatttggcgttgtcctctaaaagcaaaaccgttgtttatcatatagagttcattaccattcaaaaaaataaaagagttacttgttatatctttttcaaaagtgcatttccaagtcggttgtccggtgtgtttgtttaatttcgtcagcgtatctttggaggcgaagtaaataaaatcgttgttaataagagtgtttgatgcaatatctctaattacttcacttccggttattagtgcaccatagtttgttaaggaacctccaataactccgcctatcaacccacctactaatccgccaatgagtcctcctataacagcgcctgtaatttctgtaccagatggagttacgttcaaattttttccggttggcgtattataatcccagccttcgcctgtattaatatttatggaatgcaagccggcggcggctaccaataaagtagagtcgttaagataaaagtaatcgttccagccaaaggctctgttaatactccttttccaaagcggttttccactccacaaatgaacgccaaaaagattattggtgtaatagccatcaccggctgcaatatactcgtatgcaacgcccacattacgtttcggattggcaaaatagatataatttcttacacgccaaaggttttcaccggtgtttgcatctaatccgtatgcatcattataatcattaaaaatcaatagattatcaaactttaacaattcgcacatatcataatctatggcttttgtccataatattttatgattatttaaatcgtattgtaaaatatttccttttgctttcaatccttctgtcatagccttatatcctcgtaattgaagcgttagaaaacggttttcagtatcaaaaaagtaattgtcaattctatcctgaaatttatattcaatgccttcaatgtcagaaccatccatataattttttccaacgatttttgtttcggtcatcactttcaactcttttttttggctgaaagcggtagtggaaaagaatagcaggcaaaaaagcagggggatgaatttgattgttctcatttaagccagtattttttctttaagatgagcttttgtttttctatttgtaatgacagagttattgagtgtactaattttctttggcagaggatgatatacagattcatattcaataattgcgtcggaaatggctttatattcttccaaaattatgcttggaatattgctttcatcttcatattgacaaacttgcctcaatagaacttcagatctttctctaaaagattcaaattgtttgggattttctatgatcatactctctttcataattataaattttgaatgtctttaattttatcatattcagcatgggttccaacaaaacgaatttcaattatttctgcaataaaaacaaccacaacaaccattctgtaattatttccttttatattaaacacatatcgtttattaccaataaaatcagcagaaggatagtctgttttaagttcgttatgattagtccattttgctttacttactatctctatccatcttgacaaataatcccatgcatccgaatgttttttgcaaaaactttcaattattattgccccttttattttcatttctctaaatttggcgcgaaaataaaaaaatccaatatgttttaccacatattaaatcaaccccagcaaaataaacacccccgaagccaccacgaaatagccgccgtcaatatacagcaacgccataaaacgtttgcggtttggggttttgaagagcaaactcgctttcatccagccgaaggtggcaaagcacaccaaaatggcaaggcaaatactgtatttcactaaaacaaaatacataaagcccagcaagcagatagaaagaaactgcataatcataggcagaaaagcgttgaggttgggtttgcaggtacatttctcgcctttggaaaggtcggcgccgcacgggcactcatcgtagcgcaccgcccacagccacttcttgccaaatagttgattgtaccaaaaaaagccgataaaaaacacggacacaacggcaatggaataccagagccaggaaaaaatacaacaggtcataatttaagatttaaagatttaatatttatggttcattatttttcgttacaatcgttacacgttacattcttgtttactcgtccacttgtaacttgtaacttcaaacttctaactattattgtactatccggcattataaaacgtatgcggacttttttgcgctgccggtaacaattttaccccaaaccacgtaaattgcagcgaaagaaatccaatcatcaaaataatgaataaaaacttgcgatttatttttgtaagtttttgaagatgaatat

SEQ ID NO: 309 - DNA, 6432 bp, unknown
  metagenome-derived sequence
  misc_feature (1)..(6432): Contig with Unk54 CRISPR spacer BLAST hit
  misc_feature (6064)..(6092): Unk54 CRISPR spacer BLAST hit
tctatatttttccgaacagtttccaaaaattttaagataatctggcaaaatgtttacattttttttcggtggataaatatttgttttcgtaatacacgacaaatattttacttcttcggaaaattctggcgttgttaataattggtgaatatgatttataacaaatggctgctgcggtgtgtacgcgcttatattgtgcgttgtgaacgcaacgcgcatcaacgcttttcgttccattttcatatattttgcaatatttctgtaattttcaataggaatattgtaataattccaaatgaaaaaaagttggataatctgatttccgcgctgcaaataacttacggattcctcaatttctgcatctgttatctgtttttgtttgggaaggtgcgccaacctgtcatcttctgttggcaactctattccaaacctgacaatattttgatttttgaaacattgtttattattaagaaaatattttagcgttgtgctttgcgaagtgtaatcattgtttctgcaattttttattctatcaaaattgcaacccttaacaattccctcgttactcaaaatagttatttgttttgcttttaagtttttatctaaatattttatttttgaaacaaaatcatcgttatcaatatgggaatatttgttggcgtgcgaaacaacgcaaaattcacacttataagggcaaccagtttcggcgtgcaaataatatattttttgttccgttttcacaatcggcaactgtgaatatggcacttctctatttatttcaacgctccgccctatcattgtttcatcaataatatgcttttcatcaaaattatacccctcgccaaaataaacaaagtccacaagtttcgttttcaaaagataacgatataaaaatagtgttccaattcctcctgctattattttattgttcggatatttttttctaattgtgaaaatagaaggtagtgaatcggtgttgaaaatagttacccctataacatctgacggttcgggtgaatattttattgaataaattttcgggttgtaaccacaaagaaactgcgccggtattgaataataatctttgcaaaattcttttaaaaaactgatttgcataacttcaaaattttttcttcaagttcttttttttcgcacggtgtttccaaattttctttcaattttacaaccaattcgtaaagttcattattcgggcgaaccataaaattaaatgtatcaatacgaatagtcaaatagtcattgtcttcgcgcgtttttgttccgcgtccaaaaagttcatcatcgccaattatttcaatgttttcaattcccaattctacaacgtcaatttccaactcttcaatcagaacctccctaattcggtcttcgtcgaggttaatatttttttgcgcggtcgtatttgccaacagcgccgcctcgtaaaattcgcggctgccactttcaatatctgttcgtttcaaaataacggggcgcgttccgtccgtttcaataataataggttcggcatcgggcatcaaattgtcaaatgttttttttctggcgttgccgctcaaaataacatcatcgttggaaacggttacgctttcaattattccaacctttcccaccgaacgttccaacagttccatcccttcttttgtgtgcgcgttaaaatttcggtcatcaaacctgattttcatctgtttcataaaatatcttctattttggttaaatttttcaccaactcaacgcggtgggtttgttcgtaatagccttgcaacttcgcaatctcctgcgccgcgagagcggcatccctaaattgcggcaaaagcataacatcgccaacccttttaattttataaccggcaaagtcgtttcggaaactattccattcccttacctcagccgcgtaaaattccaataactcattacgcgaaataaaggcttttgccgcacgttcttgtatctcccttacccttgcctcctcttttgctttttcgtcgcgctcaagccttccttgattgtattgacgggcacttttgaaatagttataaatagtccgttccgttctatcgtatttgaaagcaaattttttcacaacatcctgcccgtttttcgtaggattttcataaatgtagtctgcaatttcaataattagctgttgaggtgtcattttgttttaatatttttcaatttttcggcaaaaataaaaaaagaattgagacaaatggcggtggcactcattttccctaatcttatatttttattcatttgatttatagcgcgttaattgctttttgtttcatcttatataatttttccttcaaaatctaagaaatatatacttatttatcaagagagtaagaaacacgcgaatatattatattctttactatgctacttctctattatatactgttatagggggatatatataatataatataatgttttagttcttttccgtaacgcttttaatgtcaaatttttgcgccttatatttttcggtttatattatataatattttataaactaattgaatatcagtactttattttttctttcagtttataagatttttcgttttgagccatttttttgggttctttgtcgggtgcaaaaatattttttttttaatacaaaatatcaatcattgcaaaattttattttttcttcggaatcccgtaactcttataataatgttaagtcttccattacagtagattttttagtaacgttgtaaatttcagaacctctttacattccgtacagtcaatatccaaagaacactcaaatgtattgttttgtcggcaatactttataaacgcctcacacgcagtattacaacagtgttctcgttctatatctaccgaagtttcagcgttgagtaaagtaactttactatctattgtttggtataaatattcttttcctttcacagtttttcaatttctggtttaatggacattataaaattagtgctatcaattttaagttcgtaagtacgaacgctcggaacaatttgagttccggtattgtttctcccgtacaaagtgattttgctttggtctctgacgtgcaattgacaatcaaattgaaaattatacgttttgagtttcagaagttcggcaatagtcgccgcctgttcgtttatagtttgcgactgttcggcgcggtgctttttcaggctgctgatgtgaacctgttgaaaagcaaccgacgccgccaaaattgcaattataaaatatggaattagtttaattattgctttcattttttttgttttttaatttaaaacattctgcacagtcggtacagtcggaacagtcggcacagtcggtacagtcggaacattctgcacagtaggcacagcgtgcacagtaggcacattcggaacagcgtgtacagtaggcacagcgtgcacagtaggcacattcggaacagcgtgtacagtcggtacagtaggtacagcgtatacagtcggcacagtaggtacagcgtatacagtcggcacagcgtgtacagtcggtacagtcggtacagttgaaacagtcggtacagtaggtgttcatatcgttgtcgcaaataatatgaatttgctcttccgttaattctgaatactcttttattttaatatttgatttttcgcaaatctgctcaatcgaatatcttttttttattatttctaattttttttcaatcatttttttataaatttttcggggtttataggattattattttcgcgtaattcaaaatgaaggtgaacgccggtgcttgcgccggttgtgccaaccgtgcctatctgctgccaagcggaaactcgttgccctgttgttacgctatatttatcaagatgcataaaaataaaggttagcgcgttgttttggatttgtatccaatttccggcacttctcgaaaaagccgctaattttacagttccggcaaccggtgaataaacgggtgtacctttcggaactcccgccaaatcaattccgttatgattttgcataactccggttatcgggtgttttcgcattccgaacggcgaagtaattttgtaatctccttcaattattccggtcggcgcgttttttttctgcgccgccggtgctgaatattgcgttactttcggaaataaaacattccacgttttttcgcctacaataccatcgggcgaaattcgcgccatctgctgttcggattttacagcgctttcagttccgcgcccaaaaattccatcaacttgaataaaatagccaagttctttcaagcgcgtttgtaattttttcacgtcttctccgcgtgaattgatttttaataatttcataattcattatttaataggttaataaaatctttcaatgatacacaacatttatctttacggcactcaaaatgttctatttcctgtggacactgaaagacacaaaaacattcaatcgcttttcctcgcatctcatcttcggcgagttcaacggctgtaatcatatcattttcgctaaaattcagatgattagtttgccaaatttcatgtaattcctgtgatttttcaataaaatattttgctttctttgtttgcataattaactatttaataggttaataaaatcttgtgtgattccgcacgtttcacagataataattttcggacattctatatatgggcaatttctgcaaatattacaatgttttataaatgcgtttaccgccctttctaccatttcttcttctgccttattcaccaattcggcaaccgttgctttgctcaaactaaaatcttccactttcaacagaaagtcatttacatatttgcttttcatctttttaaaagttcaatattcacagtttttttaatttcgtttccggcggcgtcgagttcggtttcaaaatagagcgcgccgcttttcgcaatttcattgttcaatttcatcgctgcatagtgcaaccgctgcgcatcagaaattcctttctgttcgtagtcatcggaaacaataataattcggtcttcgtaatattttacttgctcgcgcaaacttgccaactgttcgccgtcatctttaatcctcttttgaaacttttcgtattcctgttggatttttgaacgctctaaatttcggacgctgctaatttcttcgttaaaataattttcaattttaacaattttttttgtgtattttttttgttgtgtcatcgctgctattatgaaccccgctgcgaaaataaatggggaaattagtaataaaatcataacgttttaatttaattattttgtggcaaaattaccgttttttctttaaaatttttacaaacttcgcaacacttttgccggttaattcggcagaaaaattttacttcaagcctatttttttggtgcgcaacgaaataagcgcaatcggtgtatgttgttttatttttcatagttccgttgcctccgcccaagtaatattttcgtaaaccattgccgaactcccaaccccttgacaatacttcaccttttccaaaagaagttcgccgtgcgccgcgcatattctgcccaactcgtttttcagaagtcgtttttgtttttgtgtcggctttccaaaagtgcgaaatattgcatcgttaaaatctcttatttgaatataagcacctttttcaaatcggaacatttttttcatatcatcaatttcagactgcacaatatttttttcaacgtccgcgcttttaggtttgtacaaaaacgattttataaaatctcgaattattccgtcccgttcttttagaaaaacatctaaaaatgtttccttttcactatcccaatagataggatagcgttcgtttgggctctcgtattcaaccaatcggcgcaaagttccgccgtcaatttcggataatacgacattgttatttgagaagtaaaaaacggtcgccaaaatttcaaggctgccgccgttggctgccaactccctgtaaggtatcgttgtgccgctcgttatccttttaatcaatgtattatctttttgacgttcatcgctttcatcaatcattatacaactcgccttcgccattgcccgcttttccggcaagttatcatagtgggcggcgcgtggattaaaagcctcctccgtgatttctacaaatagccccttgaaaacatttttcacaacgtccacaaaggacgatttgccgttgttacaatttcctttaactgttacgaatttttgcgcgcctcgcgttctgcgaaggcttgacgaaaataatgccaatagttcgtaataatcatcatcggttttaattccgaacacgtttcggcaaagaatatgaaagttttttggttctgcaacatctgctaacttcatcgggtttgtgttcataaatatattatcaatacagcacacatctggcgtgcgcggataaataatgtgcggttcggtgtatttgataaaataatc

SEQ ID NO: 310 - DNA, 6425 bp, unknown
  metagenome-derived sequence
  misc_feature (1)..(6425): contig with Unk54 CRISPR spacer BLAST hit
  misc_feature (4102)..(4131): Unk54 CRISPR spacer BLAST hit
agagataatgaaggcaatcttttatatttttcagatggaaatgggaatggagaatatgaacgttcatttgcaacaataaacgatgcccttgaatttattttagaagatgaagaaattgaaatagaagaagatgatgatgatttatagaaattgaaatactgaatatcccccaaaattttgggggatttttttttggtttccggtcgctcgcgcgtgcgtagatgatgcgcacgtagcgcgtggctgatgcgcgcataacgcgcgcgcgaggctttctaaaattggtaaaaatcggcaaaaaagcccgatttcttatatttcttatattttcaaaatttaaaatataagacggaaagccgcgaccacactcactttgcgcgatttcttataaattagaaacttttgcataaaggaagagaaaaaaaatagatatatatataaatagaatgaatatatatataatagatattataatattcttattattattataactatatagtaattaagtatttatatattatattttaatgcaaatattatataagaaaaatttacgaattttgtaacaattttatttatctgtgtttcaataagttataaataaaatgtaaaaaaaaacgcttttttttacaaaaatacttgtttatattaaaaataaatgtatcttcgcggtgcaaaagcaccaaaacaaacaaaaaaaattaactcttaaaacccaaacaaaatgaaaaatataaaagaaacccaccgaattatgaaaaaagcacttataatgatagcgatatcattggttatttatttaataatttattcacttacagcgtttgttgtatgggaatataatccatccaaaatgcaagatggggaaagattatttattgttttctttggtacattacttgtttgtattgcaaatatagcatacatttcagaaacaaacaaaaaataaaacaaaatgaaatttgaaattaaaaaatttaaaaaacacgccggaatttcaatagagatgccggcgattatcaccggaggaaacgctgttggtaaatcatcaatttacgaggcagtgttattttgtctcaatgaaaaggatattaacggcggagaatttacagcctccaacgtttacgattataaagatgccgtttcggaaaggtgggcagatgttgcattttattgcgaaggtggtatttttcgtaaaaaggcgaaacctatttatgaacgcgagcgcggttcggaagtagaaaaattacgaactgaattaagttgcgaatattttttgaacgaaagccccgtaaaaaaatcggactacgatgccgcaatagcggcgatgtgtaaaaattttaattttgcgctattcacaaatccgatgtatttctttaatttgccacaaaaggaaaaattaaagataatagccagattaacagatatttcgttagtggactatttggaaggtttgcctaataaagcaattttgaaatcagaaattgcagcgcaaaaatccaacattgaaacgttggaaatcaaaaacaaatctttatccgaaacatttgcaacgcgaccggtaggagaccggaacactgcaaaaattgcagcacttcgccttgaaattgaggcactgaatgccgaagaaaaatcggcagttccaacggaaattttgcgcgaaaatgaaattttgcgcgaaaaaataagagatatagaaggcacgcgctttgttccaacgcctccggttatcttccaaccggaacaaaaaaaagaactctatattttgcgagacaaatttgaaaatccaaaaatagcaacgatgggcgttgaatggcgtgcattaaatgcaacgctcgaaaccttgaaattgcaaatagatgaacatttgcgaaaaatggaaagtttaacggttgaaaaagcgttaggaaaatcaaaagaaaatatgtgccagcgttgcgaattttgcaacgttgaatgttccgaaattattaaaaacgaaaataatgcgattttagaggctcaaataaaaaaaatgatagaagatacagaattagaatttgagcggcttaaaatgaaagaaaacgacattaaaacgcaaataagcgatataatagaagaagggaaaattttgcgcgccgaagatgagaaaaaaaataaggttatagaaattgaaaatgccgaacttctgaaacaaaatgaacttataattgaggcaaacgaaacgattaacgttcggaacgcggaggcgttggaaaatgtaaacgcaaaaaatgcagaaatacaacgcgaaaacgcggcggcggctattatctttgaaaacgaaaaagcgcaaaaaattgaagagttgagggcgaaaatagttacagatttcgcaaaaattgataacaccgaaaaaataaatcagttggcgtcaaaaaaatatgacattcaaaaagaagatgaagaaaaagataaggagttgcacgcttgggaaactgctcacgcgcaaatagaaattaataatgaccacgcggactctgttcgggaaaaattgatagagaatgaaaaattggcgattaaaatagaatacgcggaacgcgcctatcgttcggactgtgaaaacaaaattaaggaatttttgccagaaggagttgagattgttttgttccgaaaattgattagcgcggacggctacgaagattgcgccataatgaaaattgacggctacgaaaatccgaacacaagcagagccaacacaaaattggctattttgtgcgaaactttacaaaatcatttcgctatttctcttccgattttctttgacaacgccgaaaattgcgaaccaaaaaatatgccgaaaattaaaaacttggtggaatttagagttgtggaagatgaacctttaaaaataaatggttatgggatttagcgaaaatatcaacgtcgaagaaacaggctatttgaaaaaaagaaatgaaaatttgcgcgtagcgaacaaaatggcaaatgaactactttgggatatgcgcgcactttggcgcgaaataagacaagaaaaaagattattaaaaaaacaaacaattaactatgaaaaaaacgattaaacagggtagtgtagatttctataatgaaattcttaacaataagcaatattttgatatggataattataatttcgatgatgttattaacgctgggatttttgcatttgtggcaggcgcggcgtttgcgcagaagtggtatagagtggaagatgtgtttcctgaattagacgatgtagtattatttacatctgatagaacatacatcggaacatacacaaatgggaagtggtttgacattaacacgggaaaagtgtttttttccgatgaagtagatttatggcgaccgatagagttagagtaaaattattaaccaacaaaaaataacattatgattttacaaattgaaagtattcaagcacaaaattgtccattagataatatagattgcacgtggtgcgaatattacggtggacttagaattgatgatattgaatgttattatgaagaaaaaatagatgtagaaacatcagaaatagaaattaacgacccgaatcaattaacattaaatttataacattatgaacaaaaaaatcaaaattcaaatcaaaaacaggtttaccggtaatgttatctttgaatacgaaaaaaaagataatacaatcaaggatacagttgaagaggccgttaagaacggggcgtcattaaacggggcgtcattggaaggggcgtcattaaacggggcgtcattggaaggggcgtcattggataaacgatatatttcggtagcaagaataggaaaaagaaaagatatagcaacttattgttttgaagatgatattatttggtgcggatgttggattggtaatttagaagattttgaaaagagagtaaaagaaacgcacgccaacaacgagcaatatttgaaggaatatttgggatttattgaatacttaaaatcattaaaataatgaatagaatactgaaatataaattagagttaagcaaataaaaaatgatatatttatgaaaaaaaaagtacatatagcggcatcggagctcgtgccgttatgcgaatttttgcgcttaaacgaaatttttaacccaaaaataaacaatgaattattaaccaaaatttacaaagaaaatggaacagaacaaaaaaaatgaaacgttgccggaagtggcaacgaagacgcaaacgattaaagtaaaatcaatgggcgcgcagttggcggaaagttgcctcgaacacacgggattagaatggcgaatattttgcggaatgaaaaaaatcgaaacgttggaagtttatttaaaaactttgaacggtgggcagggaaaaacgattgaccaattaacagaattagaaaaaaaagaggcgaaaaacaaatgggaaatgggcgaagtgttgcaggtactcgaagaccttcgcgcctctaatataaaccctttaatgaaaaccgtttatttcgttaaagttggcggaaaggctgattattggttagattattctttcggaattgaacgggcgcaaaactcaaataattttgacggcgacgaaaacggaataattattgaaacaaaagaaggcgaaattttacaccgaacaggttcgtggactacatccaacgacaagttgattgggggttgggcgaaagtttggcgcaaagaccgaaaatatcccgtaatcgttgaggttggactttctgaattttggaacgataataatccgatgtggaataagaaagcggcttatttgattaataagtgcgcaattaacaacgcttacaagcgcgcttttccgaaggaatgccgcaacattggagataaagaaatagaaccggaaatcattgatactacctatacggaagtaaccacttctaatattttgcagccggttaaaccggaaactaaacccgaacaggcagcaggaccggaacaggcagcaggaccggaacagaaacccgaagaaaaaaatccatttgaagtatgaaaataaaggtattggcgaccggcagcagcggaaatagttatgcacttattgatgagggtggcaacgccctcatcattgaggcgtggttaaacccgcacactgtattagaaaatttaaagaacgaaaacattcggaaatatgccggttggtgctattcacacgaacacggcgaccatttcgtttataatatttccaaacaatatgatatgtatttcggaaaaaaaataagtgaatttgccgttgtatcatttccattattgcacgaccggaaacatccgaaattcaaaaatagcggtttcgtaatccaaacgcgatgccggaagacaatattatttgcaaccgatttttacgaaataccggaagtcgtattatgtgaacttgaaaaaatatcatttgatgctattttaattgagtgttcatataacaattttatttataaagattttgaagaagaaaaaaaagcgcagttaaaaaatcattgcagcgacgataaatgcgtagattatgtttcgcgtatttgcggcgaaaaaaaacaaacacaaatattaacaattcacaagtccgagcgcggtggacgcgcagggcttattttagcaaaattttccgccgcaggtttccaaaacgtgcgagttgcggtgaaaggaacgaacttaaatttataaaaaaatgaacaaaaaaagaaaaaattattacgccgaacagcaggctgaaatgttgaaggtactcaatgccgcacaagtagactttgagagccaaactccgtacaaaaacgtatttcaatttatgcaaaacacttatggttatacgaaagaatattttgcgaaattagcgcaaaaaaacggttgggacgttattttcaaaaatggaaaatattatattggaatataacgtatggatagtttacaattttgcaaatatattagcgaccgttcgggagtttacattaacaaaataatgtattgcaatagcgaatattggctcaatgacaacggggtcctatacaagatttccacgaaggaaacaagcactcattttcgcgtatcattcattatttgccgaatgattttggacttcaataatgggaagtataattcaatgaccgatgcggaaaagaacgaccatcgcgacttttgtttcgtatttgatatgaagttaaaaaatgttattttgaaagattttattaacgaaatttttgaaccaattatttggaaatgtttagtgggcaaagatgaaatgtgtaatttcggagcataaatagaaaaatagacgtggaaaagaaaccaagccgcatggacataatacgataagaagacagactactttggtcccaggtaggcgatttttataattattttaattaatatttattaaaaaatattgtcatttgccaattcacttaatcaaacaaataacctttattttct

SEQ ID NO: 311 - DNA, 1280 bp, unknown
  metagenome-derived sequence
  misc_feature (1)..(1280): contig with Unk54 CRISPR spacer BLAST hit
  misc_feature (17)..(44): Unk54 CRISPR spacer BLAST hit
aattctggcgtcgttaataattggtgaatatgatttacaacaaatggctgctgcggtgtgtacgcgcttatattgtgcgttgtgaacgcaacgcgcatcaacgcttttcgttccattttcatatattttgcaatatttctgtaattttcaataggaatattgtaataattccaaatgaaaaaaagttggataatctgatttccgcgctgcaaataacttacggattcctcaatttctgcatctgttatctgtttttgtttgggaaggtgcgccaacctgtcatcttctgttggcaactctattccaaacctgacaatattttgatttttgaaacattgtttattattaagaaaatattttagcgttgtgctttgcgaagtgtaatcattgtttctgcaattttttattctatcaaaattgcaacccttaacaattccctcgttactcaaaatagttatttgttttgcttttaagtttttatctaaatattttatttttgaaacaaaatcatcgttatcaatatgggaatatttgttggcgtgcgaaacaacgcaaaattcacacttataagggcaaccagtttcggcgtgcaaataatatattttttgttccgttttcacaatcggcaactgtgaatatggcacttctctatttatttcaacgctccgccctatcattgtttcatcaataatatgcttttcatcaaaattatacccctcgccaaaataaacaaagtccacaagtttcgttttcaaaagataacgatataaaaatagtgttccaattcctcctgctattattttattgttcggatatttttttctaattgtgaaaatagaaggtagtgaatcggtgttgaaaatagttacccctataacatctgacggttcgggtgaatattttattgaataaattttcgggttgtaaccacaaagaaactgcgccggtattgaataataatctttgcaaaattcttttaaaaaactgatttgcataacttcaaaattttttcttcaagttcttttttttcgcacggtgtttccaaattttctttcaattttacaaccaattcgtaaagttcattattcgggcgaaccataaaattaaatgtatcaatacgaatagtcaaatagtcattgtcttcgcgcgtttttgttccgcgtccaaaaagttcatcatcgccaattatttcaatgttttcaattcccaattctacaacgtcaatttccaactcttcaatcagaacctccctaattcggtcttcgtcgaggttaatattt

SEQ ID NO: 312 - RNA, 14 nt, Artificial Sequence
  Guide RNA
  misc_feature (1)..(14): guide RNA hairpin; n=any nucleotide
ucuacnnnguagau

SEQ ID NO: 313 - RNA, 15 nt, Artificial Sequence
  Guide RNA
  misc_feature (1)..(15): guide RNA hairpin; n=any nucleotide
ucuacnnnnguagau

SEQ ID NO: 314 - RNA, 16 nt, Artificial Sequence
  Guide RNA
  misc_feature (1)..(16): guide RNA; n=any nucleotide
ucuacnnnnnguagau

SEQ ID NO: 315 - DNA, 14 bp, Artificial Sequence
  Guide RNA
  misc_feature (1)..(14): guide RNA; n=any nucleotide
tctacnnngtagat

SEQ ID NO: 316 - DNA, 15 bp, Artificial Sequence
  Guide RNA
  misc_feature (1)..(15): Guide RNA; n=any nucleotide
tctacnnnngtagat

SEQ ID NO: 317 - DNA, 16 bp, Artificial Sequence
  Guide RNA
  misc_feature (1)..(16): Guide RNA; n=any nucleotide
tctacnnnnngtagat

SEQ ID NO: 318 - DNA, 30 bp, Oryza sativa
  misc_feature (1)..(30): sequence at CAO1 locus following Unk7-mediated genome modification
tttctggagcaagtgcggcagcaaagacag

SEQ ID NO: 319 - DNA, 52 bp, Oryza sativa
  misc_feature (1)..(52): sequence at CAO1 locus following Cms1-mediated genome modification
tttctggagcaacacctgaaggcttgatgagcaagtgcggcagcaaagacag

SEQ ID NO: 320 - DNA, 34 bp, Oryza sativa
  misc_feature (1)..(34): sequence at CAO1 locus following Unk8-mediated genome modification
tttctggagcaacacctgaaggcagcaaagacag

SEQ ID NO: 321 - DNA, 39 bp, Oryza sativa
  misc_feature (1)..(39): sequence at CAO1 locus following Unk15-mediated genome modification
tgcctggagcatatttttcctcaaccgagggtggttttg

SEQ ID NO: 322 - DNA, 48 bp, Oryza sativa
  misc_feature (1)..(48): sequence at CAO1 locus following Unk16-mediated genome modification
tttctggagcaacacctgaaggatgagcaagtgcggcagcaaagacag

SEQ ID NO: 323 - DNA, 40 bp, Oryza sativa
  misc_feature (1)..(40): sequence at CAO1 locus following Cms1-mediated genome modification
tttctggagcaacactgagcaagtgcggcagcaaagacag

SEQ ID NO: 324 - DNA, 30 bp, Oryza sativa; identical to SEQ ID NO: 318
  misc_feature (1)..(30): sequence at CAO1 locus following Cms1-mediated genome modification

SEQ ID NO: 325 - DNA, 27 bp, Oryza sativa
  misc_feature (1)..(27): sequence at CAO1 locus following Cms1-mediated genome modification
tttctggagcaacacctgaagtgacag

We claim:

1. A method of modifying a nucleotide sequence at a target site in the genome of a eukaryotic cell comprising: introducing into said eukaryotic cell
   (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cms1 polypeptide; and
   (ii) a Cms1 polypeptide, or a polynucleotide encoding a Cms1 polypeptide, wherein the Cms1 polypeptide comprises: (a) an RNA-binding portion that interacts with the DNA-targeting RNA; and (b) an activity portion that exhibits site-directed enzymatic activity, wherein said Cms1 polypeptide has at least 95% identity with a sequence selected from the group consisting of SEQ ID NOs: 20-22, 30, 63, and 66, and has Cms1 nuclease activity, wherein said method modifies said nucleotide sequence at said target site, and wherein said genome of a eukaryotic cell is a nuclear, plastid, or mitochondria genome.

2. A method of modifying a nucleotide sequence at a target site in the genome of a prokaryotic cell comprising: introducing into said prokaryotic cell
   (i) a DNA-targeting RNA, or a DNA polynucleotide encoding a DNA-targeting RNA, wherein the DNA-targeting RNA comprises: (a) a first segment comprising a nucleotide sequence that is complementary to a sequence in the target DNA; and (b) a second segment that interacts with a Cms1 polypeptide; and
   (ii) a Cms1 polypeptide, or a polynucleotide encoding a Cms1 polypeptide, wherein the Cms1 polypeptide comprises: (a) an RNA-binding portion that interacts with the DNA-targeting RNA; and (b) an activity portion that exhibits site-directed enzymatic activity, wherein said Cms1 polypeptide has at least 95% identity with a sequence selected from the group consisting of SEQ ID NOs: 20-22, 30, 63, and 66, and has Cms1 nuclease activity, wherein said genome of a prokaryotic cell is a chromosomal, plasmid, or other intracellular DNA sequence, and wherein said prokaryotic cell is not the natural host of a gene encoding said Cms1 polypeptide.

3. The method of claim 1 wherein said eukaryotic cell is a plant cell.

4. The method of claim 3, further comprising:
   culturing the plant cell to produce a plant under conditions in which the Cms1 polypeptide is expressed and cleaves the nucleotide sequence at the target site to produce a modified nucleotide sequence; and
   selecting a plant comprising said modified nucleotide sequence.

5. The method of claim 1, wherein said Cms1 polypeptide comprises a sequence selected from the group consisting of SEQ ID NOs: 20-22, 30, 63, and 66.

6. The method of claim 2, wherein said Cms1 polypeptide comprises a sequence selected from the group consisting of SEQ ID NOs: 20-22, 30, 63, and 66.

7. The method of claim 1, wherein said modified nucleotide sequence comprises insertion of heterologous DNA into the genome of the cell, deletion of a nucleotide sequence from the genome of the cell, or mutation of at least one nucleotide in the genome of the cell.

8. The method of claim 2, wherein said modified nucleotide sequence comprises insertion of heterologous DNA into the genome of the cell, deletion of a nucleotide sequence from the genome of the cell, or mutation of at least one nucleotide in the genome of the cell.

9. A nucleic acid molecule comprising a polynucleotide sequence encoding a Cms1 polypeptide, wherein said polynucleotide sequence has at least 95% identity with a sequence selected from the group consisting of SEQ ID NOs: 16-18, 24-26, 70, 103, 106, 110, 143, and 146, or wherein said polynucleotide sequence encodes a Cms1 polypeptide with at least 95% identity to a sequence selected from the group consisting of SEQ ID NOs: 20-22, 30, 63, and 66, and has Cms1 nuclease activity, and wherein said polynucleotide sequence encoding a Cms1 polypeptide is operably linked to a promoter that is heterologous to the polynucleotide sequence encoding a Cms1 polypeptide.

10. The nucleic acid molecule of claim 9 wherein said nucleic acid molecule comprising a polynucleotide sequence encoding a Cms1 polypeptide comprises a sequence selected from the group consisting of SEQ ID NOs: 16-18, 24-26, 70, 103, 106, 110, 143, and 146, or encodes a Cms1 polypeptide that comprises a sequence selected from the group consisting of SEQ ID NOs: 20-22, 30, 63, and 66.

11. A plant cell, eukaryotic cell, or prokaryotic cell comprising the nucleic acid molecule of claim 9.

12. A plant cell, eukaryotic cell, or prokaryotic cell comprising the nucleic acid molecule of claim 10.

13. A eukaryotic cell produced by the method of claim 1.

14. The eukaryotic cell of claim 13 wherein said eukaryotic cell is a plant cell.

15. A plant comprising the nucleic acid molecule of claim 9.

16. A plant comprising the nucleic acid molecule of claim 10.

17. A plant produced by the method of claim 3.

18. The seed of the plant of claim 15, wherein the seed comprises said nucleic acid molecule.

19. The seed of the plant of claim 17, wherein the seed comprises said nucleic acid molecule.

20. The nucleic acid molecule of claim 9 wherein said polynucleotide sequence encoding a Cms1 polypeptide is codon-optimized for expression in a plant cell.

* * * * *